United States Patent 11,549,145 (METHODS AND COMPOSITIONS FOR INHIBITING AND TREATING NEUROLOGICAL CONDITIONS) - sequence listing, part 11

SEQ ID NO: 27 - DNA, 18527786 bp, Homo sapiens (residues 14,410,502-16,469,144 of 18,527,786)
  misc_feature (4041202)..(4061201): n is a, c, g, or t
cattgtgttttacagatattgcatttttgtgacaaccctacagtgagcaattctcttggcatcatttttccaacagcatgtgctcacttcatgtttctaggtcacattttggtaatcttgcacaatttcaaactttttttatgattatatctgttatgctgatctgtgatcagtgatctttgaagttactattgtaattgttttgaggtgccatgaactgtgcccatataagacggcaaatttagtggataaatattgtgtgtattctgattgctccactgactggctattccccaatctctctccctctcctcaggcctccctattccctgagatacaatactattgaaattagtccaactaataatccttcaatggcctcaaagtattcaagtgaaagaaagagtcatacatctctcactttaaaatcaaaagctagaaatggttacacttagtgaggaaggcacgtcgaaagccaacacaggccaaaaactaggcctcttgtgccaaacagttagccaacttgtgagtgtaaaggaaaagttctggaaggaaattaaaagtgctactccaatgaacacatggatgataagaaagcaaaacagccttattcctgatagggagaaagttttagtagtctaacatagaagatcaaaccagccacaacattcccaagccaaagcctaatccagagcaagaccctaactctcattaattctgtgaagactgagagaggtgaggaagctgcagaagaaaagtttgaagttagctgagttcatgagtttaaggaaagaagccatctgcataacataaaagtgcaagtgaaacagcaagtgatgatgtagaagctacaccaagttaaccagaagatcaagctaaggtcattgatgaagatgactacactgaacaacagattttcaacatagatgaaatactcttcttttggaagaagatgccatcaagttgacctctggttagggcataatgcagctggtaactctaagttgaagttctgctcatttgccattctgaaaatctgaaggcccacaagaattatgctaaatctaagctgcttatgcgctataaatggagcaacaaagtctagatgacagtacatctgtttacagcatgttttactgaatattttaagcctattgttgagatatactgttcagtagactgtggaagggaattcttaaagaacttccacagtcaatggatggcttgaccaacattaattttcattccttactaggtatgttcattggacagataaggaaactgagactcagagggattaagacatttgtcccaggtcacacagctgaaatagagctgaaatcccaatgatacacactgctactcccatatccccacacaaatactgaactctttttcttgttggagtcatcagaagatcaagaagttattatatgtgttgagtgaaggaatataacacatgacctgaaatccagagacacacttcagctaaaggagaaatcttgtgttccacccccctcgtggaccccccgccctgcttaacttcttttaaagactgtcagagagacaggtcgagtcctttcatcaaggcatcccataccattgactgagcacttactatgccccacacactatgctaagtgcttcctcagcttttctcattttatttttacaaccacccttccagatgggtgtgattaccttcattacagaggaagagactaaaactcagagatgtgtcttctgactccaaagtctgtgttgctaaccctcaactagactgttcccaagcctgccatcatgctcaccttagggcaaagttagaaaaacctcaggttgatgggagctattggcaagagaccacatgagctgggtgggtctgaccactggcacccaaggcaaattagagaatgtgactcaaggtactcataattttattgtactactatttgtataaataataaataccatttttgaggggcaatgcctacaatttataaaattgttgtccaagcactgtgctaagaccattatacagacatttcctgatttttgatggttagacttagaatttttcaactttacaatggatttattgagagtattaagtgccttttaacttaggatattttcaacttacaatgggtttattgaggggtaacatcatcgtaagttaagaagtatctgtatagaaatccatataaaacttcatgctggccagtgtgtaaagaaagaaaaaaaatacatgcatacttaacaatgcagaaggataaataaaaaattgattaccttgcttgtctcctagaaggtgcactgggaggcttgggaggctggtgtagcagggaccacccatatgtagcttcctttggaccttagtgccacttccctggaatacatgagcagctttaaaaacaattctcaggcttccctacagttggtgtatctataggattaagatctggccaatgggaagtgagtagaagttgttatgtgggacatttaggaccgtgtctttaaaggagcatacccttttttctttcctctccctttttccttcctgactcatggcttgagctccagcagccatcgttgatcaggaagtgtaagggatgtattggtggcctccacagacccatgcctcctggtattcacacccttgtgtagtcccctcccacactgactctgggcttggccatgtaacttgctttggccaatgggacatcagcaaatgtgatgcaaacaaagacttaataaccacttgcacattagggcttgtcttctttaaacactccctcttggcagccaatgtcacaccataaagaagcatggactagactactaaatgatgaaagactccatagagaggggccctgaaagacaggaagctattttggatgtctcagccccagcagagctcccactaaatgcagccccctaagtgatctcagctgcaccatgtggagcagaagaaccacccaactgagcccagtcaatcatggaattatgagaaataacaaaataatgttgttgcaacttgtgaggtgatttaatacagaaaccaacatgaaccaaccttgaaaatgaaaggtacacactaaggatggaaaagcagaaagatgggagttgggatccttcatgaattcatggaaccacctctgtactttatttacaaggcagcagaaaacctaatatgttgagccttatgtgtctatgttttcagttatgtgtgactaaagttatgttggggacatgagcaagcggaagacttatttgcacatcatactctgctatgaatgttggaatgcactgcccagtgcccctttaggaacaaaaatctttatctgcttggaatgcttccagtagtcaatccttggctatgagcccatttgataattgcctcagcaaacagtgccactttagccaaggtcatgtttccttcccagagtggctgacatccagttagtgactgaagcgggaatacaagttcccagcctcctcaccccaatttgggacaactttgaggggccatcccccttcagagcactcatgcaattggtcaagtcctctgtgaaggttgcatttctgctcaacatctcccttcaccctatatttgtttccttcccttcccttccatgggggtggatcccaaaggcatgtcctaataaatttcctgcacactcgtctccaagtccttgaaaacccagcctacaacacagtgtttttcaaccctttgaatgttagagtatatgtctgtaatcctcattaaaaaaaaaagataaataagacagagttcatatgtagaaccaaatcacagtgtgggttctctaggaaacagggggttaggaatgcataagatttattgggaataacacctgtgaaaaggaaaaggaacagggagaagcaggattgggcagagggagccaccaggcagcattcaggcaagacaaagtctctgccagcacaatggagagcccagagcaaagctcacccattggaggagtcttgcaccaggtgggtagatacttgtaccggcatctgactcaaccagtctctgagctgagggcctccctgagaagagcattacttctacttgaaaactgaggcagtccccaaaagagctaataatggctgggcagcaagtcccagtttgaaggggaatctgagctgcacatgtctatgactcccactagctagaggggctttttcatagtcatccaatctgatacacctgtcccactaaacaggtcaacaaacagagggtcacagtgtctgttccaataccatccagagagtcagggtctgaattatggccagttcccagtccaggggtccttccaccagacttcaagccaactcatgtgaagagaaggaaagcgtggctttgagcttcccataggcagaggccatgcctgctcagacacagctgcctctctactgcctggcacatgagtgggaaataaatatgagatgggttgaattgaattgatgtgcaaatcccaacatttggtaaccctcaccagaaggctgggctatcagcattcctggggttcctggtgctgcaccgagcagtagtcattcatacccaagctctgctgagcccatggcaacaggagtatggattttggaatcatctattcatttattcattcagcaaacatttactgaattcaaacctgtgccaggcactgtgctgaacactggggatctgacatgaaatgaggcaggcagcatccctccttcatgcggcttcccatctagtggggtaggcagttcaaatgccagtccatatgtggttataaaacatagccacaaatcctgtgacaccctttccactgggaggcagggcctattccccctcctgatgaacctaggtgagcttctgactgctttgaccaacagcttaccgtggaagtgacccgatacggcttccagggcatgaataaggccacacagcttctgcctgatttctagaacacttgtccttggagacctggactactgccctgaggctgtcatgctggagaggccatgagtatctgctctggttgacagctgagcccagacttccagccagccctatcaaggcacaagacacatgaatgaagctgtcttaggccccccagatgagttcatctgaatggctgagtgaccctgagtgcattcctcgatgccacggagaacagaagaatcacccagctgagccccactctaattcttgccccacaaaatcatgatgtattattgcatgattattgtttaagtttgggggatagtttgtcaagcagcagatgtttaacactgaaactgtgcacctggtgggctcatatcacccctctgagcctccatggccttgtggaaaatgtagataataaaaacaactacatcataggtttatgataagtctcagagaatgaaaagccaggtgctgttctaagggctgttcccatttattcgtttagcacaggaccaggtacctatcaacccctaattacagggaagtatgatttctaattgggaaataacacgctatgtgaggtatgaataaatatattaactatggtcatcagcccagttatggaggcttgctgtgtgccaagcacagtgctaggcatttacatgaacgatcaggtcctgcctggtccttcaacccttcccccattcccttccattgctgggggctgtcctctttgcagccttctttctgctccttgagcatagcaagttctctgcttttacaaatgctcagtctgcctggatctccctgtgcaccctccccaagctcccgccaccatcaccatgactggttccttctactcactcagtcctcagctcaaatgtcacctcctcagagggtccccacccccgacctcctgatctaaggaaacgcagccttcctcaagttcacgtcactcaccctgtacaaaatccccaaatagcatgattcgtcgtctgaaagtgtttaccactaggttaaactccaggggaacaagggagtcccaattgccccctgccacactcccagtgcctggaacatggagaggagcaataaatattgaaggatgaaacacgctctacatcattgggtcttactgttaggaatatcagtcaaaatcatgactattgttcattcagcaaggattaattgagcacctattgtataccaggcatcattctgggtgctggggatacaacagtgatcaaatcagacaccagttttgctctcacagagttttcattttagtagctctgtgataagatacatgtgtgaaatacacagcatgtcacgtggaacttagtgctatgaagaaaaataaggtaggcagtgggagagagtatgaggggaatcttggcaccaaattccattcttccctccacagaagggactttcggttcccctcccctccacctccgcaccctgacccccataccccgtcaacatctctcagtgtgacattttgtttgaggtctctgcagctccaagaacaatattggctttgatgcaggtcccagcagagagccctcagactggaggggggattagttcccccttctttcccctggagggggaagtcaaacagtttggccttgtggggcctttcctcactatggggaagggggcaggcctgggccttcctggcctggatcgttgactaaccctgggttctgggccatcccctggcctcctccatcccaggcagagagtcaaggtttacaaacacggagaggcctttgatcggcagcagacccccagtgttctgttttttgttccaaacctcaggccaggactatactctgttttgcctccagcaggggagacagtgggtaggtggggagtgcgcgcgcgcgcgcgcgtgtgtgtgtgtgtgtgtgtgtgtgtgtgtgtttgtttggaggagtggaaggaatcagaggaaggctcacatggatccttgattttctttccaacaggcaggctaggtttggaagagagaattcaattcaattcaaaatacctaaggagcacctactaaatcccaggcaccatggtagaaattagggctagagcagtgaaccaaacagagctccctgcccagagccccaattctagagggggccacagacagcaaacaaatgagcaagtgaatacagaggctgtggggggccatgatgcgcttgacaggaatgaagctgggcagtcgatggggctgggatgagggtgctgtgggggcttcccagacaaagtggcatttggtagagacctgaaggaaatgagggaggcagccatgtggcgatcagtgggaaaagtgtttcagggaaagggaacagctgctatgaaggccctgagatgtgcgcaaggctggcatgttggaagaacagcaaggagcccagtgtggctgacccaggggaatagtggggagaggaacagcagaggggtcagaatggggagtgttggggttggtggggggaagtggagtggttttcctttttttcttttcttttcttttttgtttttaggagatggagtctcactctgtcacccaggctagagtgcagtggcgcaatctcatctcactgcaacctctgcctcccaggttcaagcaattctcctgcctcagcctcccaagtagctgggactacaggcgcatgctgccacgcccagctaattttttttctttttttttttttttttttcagtagagacaaggtttcaccgtgttgctcaggctggtctcgaacttctgagctcaggcaatctgcccacctcagcctcccaaagtgttaggattacaggcacgagcaaccatgcccggcccctttttttttctttctttctttttttttttttagtttgtttaattttgtttttaactaaaactaaactgtgtcatccaggctggagtgcagtggtgcaatcacagctcactgcagccttgaactcctgggcccaggagatccttcccgcctcagcctccccagtcgctgggactacaggcatgcaccaccttgcctggcagatctgaactgagatttaatagaattcctgggctgtgtggaaacagtggggacgacggcagaagtggggagaaccatgagaggcaactgcaggggttcaggcaaaagatcacatggcctacgccagggtggtcaggagggggaacggagagtagttccaaattcatcagcttcttttctttttttgagacagagtctcaccctgtccaggctggagtgcagtggcgatctcggctcactgcaacctccacatcctgggttcaagcgattctcctatctcagcctcccaagtagctgagattacaggcacccgccatcatgcccggctaatttttgtgtttttagtagagacagggtttcgccatgttggccagactggtcttaaactcctgacctcaggtgatctacccacctcggccttccaaagtgctggcattacagacacaagccaccacctggcctcacagctttttattgaagtaccacataaatactgaaaagtacccatataaacatgcctgcagtttcatgaaattttacaaacccaatccacccacataaccagcatcaagctcaagaaatagaacttgtccatcccccgagaagtccccagaagccccctccaaatcactgccccttcaccaagggcagccactctctcaactctttttttttttttttttttttttagtagagacaaggtttcaccgtgttgcccaggctggtctcgaactcctgagctcaggcaatccgcccacctcagcctcccaaattgttaggattacaggcacgagccactgcgcccggcccctttttttcttttcttttctttttctttagtttgtttaattttgtttttaactaaaactaaactgtgtcatccaggctggagtgcagtggtgcaatcacagctcactgcagccttgaactcctgggcccaggagatccttcccgcctcagcctccccagtcgctgggactacaggcatgcaccaccttgcctggcagatctgaactgagatttaatagaattcctgggctgcgtggaaacagtggggacgacggcagaagtggggagaaccatgagaggcaactgcaggggttcaggcaaaagatcacatggcctacgccagggtggccaggagggggaacggagagtagttccaaattcatcagcttcttttctttttttgagacagagtctcaccctgtccaggctggagtgcagtggcgatctcggctcactgcaacccccatctcctgggttcaagcgattctcctgtctcagcctcccaagtagctgggattacaggcgcccaccatcatgcctggctaatttttgtgtttttagtagagacagggtttcgccatgttggccagactggacttgaactcctgacctcaggtgatccgcccacctcggcattccaaagtgctggcattacaagcacaagccaccacctggcctcacagctttttattgaagtacaacataaatactgaaaagtacacatataaacatgcctgcagtttcatgaagttttacaaacccaatccacccacataaccagcatcaagctcaagaaatagaacttgtccatccccctagaagtccccagaagccccctccaaatcactgcccctcccccaagggcagccacgctcccaaccttttaattatattttgaaagtaaagctggcaggatcttttgctggatcgaatgggggcgaggggagctggtgaaagacaggagtcaaagagagcccccaggtttggggtgaagttctggattcctggggctgccatttactaagatgggaaacttgtgatgggggcagagactatgggtgaaaccaggggtttgttttgggacctgttgagttttgggatgcccgtgaggccctggggaagatacatgccatcttatctaaaggttgcaaattcaatgctctcagggacaagtaacaagaggagtaagacatatctcactctcctcttacctctgtaagaagaacaacgggaccagcgtgatgacaaacagtgactcagagccaaagagcaatagggagcagtggagactggggcaaattggaaagcacaggcccctctaaaagaagaggtgttagaacagggtcccgtgtggcaagatctcctgacgatgtttccagagaagccagatgtctagatttttacatatgaaacaatccatatgtatgtttgaaattgtttaacattggcatatgaaattgtttaacattggcaactaaaaagcaaacattatgtgaacccaagaaaactgcctacagttacagccacccactggacctagatcaaatcttccactttacaggtggagaaactgaggcccagggaagtctagaattttccccaaactcacagaaggagttggtggcagactttggccaggccttgaataggctgggtctcagtgccgggttctcacctcccaggccttggtaagaaggggctggagttagtctgtctccttcactttgatctaaatagagaggctctaacctgacagtaaaaggcagcaagatgctatgaacaagtatggctttggcggcctggggtctctatctgtgttggttaggaatgcttttggcttcaagtgatggaaaatctgatttatggtagcttcagctttggagacgtttacctgtgcatataataagtccagaaagtgaggtctgaggtcactaagaacagactcacactctgcccatccctctacctcaacatcttcctctcattgactctttaccatcaggggtggcctcatggcctccagattgctgctgaacctccggttattgccattgcattgaaaagcagacattgttgatggggatgtgctggtgtcagagcagggagagaattcttacatcttctcaccttctaggagaagcaaaatcttccacagaagcaatcttcccagatttgctcttgtatcttattggccagaaaagggtcacatgctgacacggtttggaggtttgtcccctccaaatctcaggttgaaatgtgacctccagtgtaggaggtggggctggtgggaggtactggatcatggcggcagatccctcgtgaatggcttggtgccctctctgtggtaatctctgagtgagccctggctctgttagttcacaagacagccagttgtttaaaggagcccggctcctccccttctctctcttgttcctgctttcaccatgggacactgcctgctccccctttgccttccaccatgatcggaagcttcctgaggccctcaccagaagcagatgctggagccatgcttgtacagcctgcagaactgtaagccaattaagcctcttttccctataaattacccagcctcaggtgtttctttacagcaatgcaaaaggcctaatacacatgcccattcctaatcaggaaccgatctgacctttcctgagatgaagctatcttcgcctaaaaatatctagactaattgggattctgtccaaaaggaataagaagggtaggccgggtgccatggctcatgcctataatcccagcactttgggaggccgaggcaggcagatcacttgaggtcaggagttcgagactagcctggccaacatgtcaaaatcctgtctctactaacaaatacaaaaattgagaccatcctggctaacacggtgaaaccccgtctctactaaaaaatacaaaaattcgccgggcgtggtggcgggcgcctgtagtcccagctacttgaaaggctgaggcaggagaatggcgtgaacccaggaggtgaagcttgcagtgagccaagatcaagccactgcactctagcctgggcgacagagcgagactccgtctcaaaaaaaaaaagggggtgggggatgggctcacgcctgtaatcccagcattttgggaggccaaggcaggtggatcatttgaggcgggactttgagaccagcttggccaatatggtgatatccccgtcttcactaaaaattcaaaaattagctgggcgtggtggtgggcacctgtgatcccagctactggggaggctgaggtgggagaattgcttgaacctgggaggtggaggttgtgatgagccgaaatcacactactacactccagcctgagtgacagagtgagactctgtctcaaaaaaaaaaaaaaagagggtgacttttggtaggcaataatgcctggcacaatttctaccatttacaggctgatgactctgggaaagttgcttagcacctctgagcctctactcccccatctgtaaaatgggtatggcagatggtattttgtttcttgccctctcagcatccatttcctatttttctgatgacatactttgattttccttcaggtaggagttttcagaacagcagcctcagcatcacctgggaagttgttagcaatgcagattctcaggccagtctcagacctttgattcagaagctttggaatggcagcctggcaaggtgggaaagtgcgtcttgtctacccttagcttataaggggaacaaatggagctgtattataatcacctgtttgctgttctctaaaaatagtagccacttaaatgacatcacgataatgatattgctcattgtcaccatgtgccatgcactgtggtagtgctccaactgctccacgtacctccttatatggatgcttgtggtggacatggatgtgcgacccagatcccttaaggaagcacctattgccccagaggcagggagagtggtcagcagtcagctcctgtggtcagctcctccagggatcaactcacagtaggcagagagtggccttgccagagctcgtgtcccttccaggcgtgacacccccaacgactgcataatgtgagactgcaaagtcctggccatctcaggccatcttgtgacatctctgaagagccatttcaactgcagagctcccgcagaattgactgaagctgctgctgggtctcagctccagttctccctctgcccgctcctgtgtactctgccctctcctgtgtcctctgccatctcctgtgtcctccatgctgtggatgttgatcccaagggcagctcaactgtatctgagtctgcttcctggggatcctgaccagtgacaatactcacagcaactccaccatgcagcaccactgtgagtccattttacagatgaggacactgaggctcagagaggtacaaggaggggatcctaggccatgcacctggtaaacaaggagacatgggctgggaagccagcacatttgtgaatagagaagtggcatgttctggctttaaaagggtcccctgggctgctgagtaaggaagaacggaaggggccaggacaagggcctcccaggccgcggctggaccttgtcatccctgcagcttcttcagaagagccagacgcagcccatgtgctcactaagtacccagtgaaggagtgagtgaagagagaatggatgaaaacattaagactggaaggaactagacatcctcacgtccgtctccctcattacatggtgcataattagcacagtgcctgctacacttaggtgctcagctaaggtggcgttgagtgaataaatgaacacgttcaaggaaaggagggagggagagaggggcatggacttgggaagaaaagatggaagtagaggaaggagaaggggagaaaagaaagggaggaagaaagaggggaaggagggaggagggaggaggaagagaagagagaaagtgaagggaggtttacctgttcgcaccaagaatgacagtaacttacgacccctggtggcagaaaagtgcacagtccattgaaattgcggtgcctagaattaaaggacgcaagggaagactcctagttccccaagaggttcaggctgcattcatttgttttctattgcttttaacagaatacttaaaactgggtaatttataaagaaaaggagtttatttcttactgttatggaggaatacaaggtcgagggggcacatctggtgggggcacagccttcttgaaggtggggactctacagagacctgaggcggcacatggcatcatgtgacaagggggctgggtgtgctagctcaggtctctcttcctcttataaagccaccagtcctgctctcataataacccattaatctattagtccacacgtggattaatcaattcatgagggcagaggccttaggatccaatcacctcttaaaggccccatctttcaatactgctaagttgggcattcagtttccaacacatgaaatacggggaacacattcaaaccacagcaggtgcagacccttgtaagaacatgggctcctccatcagggctctggcagtcagtgacagctgggttaggactagggtgaagcaagtgaggcacaaatttaaggaggcatccaaaaactcaataatccaaaaaatatcttaatgggatggttttaaaaatcaaattggcaaactatcgcccacgggccgactgtctgatttgtaaataaagttttattggaaccagggtcaggaatatggtggattcttgcagttaaatcagagattatgccctgcatgccttcgctaatgtagatgttcccaacccctaaggtagcacgtggtgtgggcgtggtcagctcagctcatccaacaataagaacacagcttgtttggagcactcactatgccagctttaaagcaactctactctggaactacctctcttggccccatggactggccacaaaagcacttttaaatgttccaggaatgtgggcctgtgtcaagtgttggtcgcatctcggtgtcatatcacatttccctggttctgccatttactaactgagtggcctggggcaggacttaatttctctgtgtctcatttgcttcttctgtaaaatgggttaatgcatggaaagaacgtaactctataaagtcagctgctgttgttaaaagcatgggtctgaatcccagctctgtcacttattgtgaccctaggacatatttcctattgcccagtgtttcctccaccataaaatggagattataatcctcatctggttgggtttagctggggattcacacaaaactgctagtgctgttggctcagcactgcaaagcacctgcagctccccggtggacgtcaagggatctgaaagtgcagagggttccttagccctttgtgagaggaactaggaaaggaatccactgttcacctaggaacatttgttaaccctttatttcccactgtgggccaagggctaagtgtgcagatggacgattctcctcctgggggcatttgtgacgtttctccagtctccaatatctgccactctccctcttgatacttgcaaagatcattactgcttcctgacagctgcggctacccccactgctactggccactgataccggagatagaaattatttaggcagatattcagggcaaaagagtcctcggcggaatttcccttctaacaaaaaagcagccccagaaatcatttcttttctaacaaagagcagcctgaaaaatccagctgcaaacatagataaggaagctggaagcttgcacgggggaatgctggtagctgtgccaatagagaagggctaactgggggccaggcatgtctaacacgaggctccatcttcccttttcttttaccacgtgtacagtaataaagaaatgggcaacatggcacagctcaggcagagaactcgcctgcataataaaagactggggtgggggtgccgagattcataccctgtgccaatggcacacctgggtccaaccagtttttcacaccctatgtagatcagacagcacctcctcaccagctcatctataaaactcccttgcatttcactgcagatccagcaacccatttttccaggacccctcttgtagcagagcgctattctctttctttcaactattaaatttctgctcttcacctcactctttgtgggtccctgtccttgatctccgtgaccatgagacaacgagcctcgggtgttacccccagacaagcctgcttctccaccgcgttccctgcctcagtggctgccaggtcctgtgccaagcagttggagcatgctcgccacagcttccaccctggctactgtttttactggaccagctggtttcggtcgccttttcacttccaggtttcttgcttccactcttgccctctatggttttctgccagcaaccaatgcaaccctttcaaaacaatcaggtatcaccctgttaaaaaccctgagtcccattaagaacaaaacccaaccttgtaacagggccctgcaggatccggccccgcctctcccatctcatgttctgctcctcccccttgctcactaatgccggccacaccagccttgctgtcggggatgtttcttcttcgccaacttcgcacgccacagcctgcctgggatatactctcttcatctcctgtgtttctggttttccttcacatcttcactcatcactgtctgaaactgtcttatgttccccaggaaagtaagcttcatgttcccctctattagatctccagtgcccggcgcatagtgagtactagtgtattagtccgttctcacactgctgataaagacatacccgagaccgggtaatttataaaggaaaagtttaataactcacagttcagcatggctggggatgcctcagaaaacttataatcatggcagatggggaaacaaacacacccttctccacgtggcagcaggaagtgccgaacaagagggaaaagccccttataaaaccatcagatctcgtgagaactcactcgctatcacgagaacagcacggaggtagccgccccgaggattaaattacctcccactgggtccctcccatgtcacgtggggattacgggaacaattcaagatgagatttggatggggacacagccaaaccctatcaactagggatttgttgacttaatgcacacgagccaaccataccccaacaaagcaggtactagccttatagtacacgtgaggaaactgaggaatgaggcatctcattcatgttgggaatattaattgaaaaacctgtcagctcctgtggcccttggagttccttgaaaataatgttatacgccaatacttattatagtactgtaaagatgcaccatatcccatatctcatttgtcagtggaaagaacacagatttggagccaggtaaaagtacctcttgctacctgtgacgtcttggacaagttcccaccttttggggccagtttctccatctataaaatggggataatgcctaacttaagagttattttagatccaatataaaaattcccagcccaatgcctggcatgcagtaagcaggcaattatattatttttcctctctactagtcacaactacccaggaagggaagttttcactcattcctggccatccgccccatgctgggcacttggggcatgctgactgtggtgaatgaaacagacagggtactggtcctactattatagaatgtttgcttcataagaacaggcactgactgtatcatctctgaacacaatggaatgaagctggcaataacaaaagaaaaattggaacatttacaaatgtgtggaaattaacagatttctaaacaatcaaggggtcaaagaagaaatcacaagggaaattagaaaatactttgagatgaatgaaaacaaaaacacaaaataccaaaactgagagtgtgtgatgacaacagtgtgcagagggaaattcatagctgcaaatgtccatattaagaaacaagacagtaactatgtgaggtgatgggtgttaattagctcagctgtagcaatcatttcataatgtatatcaaaacatcccactgtatactttatacttttttataaaaataaatattcttacaaaaggacaggcgctgtgtctgtctggctcaccattgtacccaatacccaacagggtgccaagtacccaatacccaacagggtgccaaggaacacaaaaggcactcaaaatatgtttgttgattggagtttacaaggaagaaaggtattttcttatccctctcttcccttcccacccaaacatagcttcttctaagaaaagaaactgaggctgggcaaggttaaaagctagctcctggtacttttgcatccacactcagtttacctgtgccttaaaccagacttcatcaaacttcagtcttcacaagtcacttcaccatttttgctctacctacttactgcctgtgatagaaatcaactcagtttgtttagcggtataaacttaaaaggaactttagatcaatcacttgtcttagaaggtaaccacaaaaatacaaagcaataaaaataaaaacatgttaacatgaatttcagttgcctgaaagctgtaagtctgcttttttaaaagagaaattggagttaagcagacttttcattttttgatcatgaccctgaaagagaaatatatttgacatcaaaactcagcacatatccttggtctatatatacacgtgaaagtttcataaaacaatacactgatattttccatgctgtattctatttcattttttaaaatgctggttgtatcccattaaactggtttcaaaataaatataacatgtacacaacaacaacaaaaaaaaacactgggttagagggccagtaagctcagcgagtatcagcaactgagacttcatccttgtctcacaaggactaaaaagagaataatgttctcattatgtggttcaatgccacacccatgtatctgagatatacatgtcacaatctgggagaagcctgtcctcaatttactttaaatacccaattctgcctagaacatgacttagacacatagtaagctcttgagtgaagtgcagatgataatgacacgatcacataccacttaaaaatatcttaacacctttacttagatctcatctcatacttgtagcatttcttcaaatttactttgaaaaaagagcttcactgtgtgtggttgtcatacacattcttctacccaaccatggacctctttcttcctctcaggcgcacttcatctaatttttttagcactggcctggcctttttggaggaggtggagtagctcttcagaaaggcttcaaacacagtttcagtgttgggatgggtactgaggaaggccttctccaggacatagaggtctactcccttatcctctggaagtgctgaaatgaaactcagcccaaagtctatgagcacaatgttcagctgttccagggggggtttcaggagcatgttggaggtggtgagatcaccatgaatgaggtcttcatcgtgcattcgagccaaaacctgcccaattgtcttggctaagttggagagaccctggggagttttttcagtctccatagtggactgaatataatctcgaacagtcactgagccttcaatttcttccatatataagcagttggaagcatagtccacaaaaaagacaactggggcagatattcctgaaatcaagacataagtggttattgggttggattttttttaacgggtaaacttaattttcaaagattaagccagtttttccatctatatctacttatttcaggactattgaggaatgctacaggaaatggtacaactgaactcatctggaatattcccctgctcatgcccactgcaggactatgcctgggaacaccccacagctaaactgaggaggccatagcttcctcctcccttccaaaccaccctttctcactggacttcatttgtcacactcactctctaaaaaacaaacaaaacaaaggccgggtgtggtggctcatgcctgtaatcccagcactttgggaggcggaggcaggcggatcacttgaggtcagaagttcgagacccccatctctactaaaaatacaaaaattagccaggtgtggtggctcacgcctgtagtcccagctactcgggaggctgaggcaggagaatagcttgaactcagggagcgtaagttgcagtgagctgagattgtgccactgcaccactccagcctgggtgacaaagtgagacactgtctcaaaaaacaaaaacaaagagcaaggcacagcccagtcagagcagtttctactgatgaggacacaaacaggaggccaagcagtgtgctagcttcgaggttcatcttcgtagtcagagaggacagggttcaaatcccagctgcttttcttattagttgtctaatctaatcttaaaattacattaacttctctaagcctcagtttctgctactatacaaggaacaatagctccaataaactcaatgaatctttactgaaagtcaaccaggctcagtatacttttctagaaactgagagatgttatcaatggggatacagcaataaacaagccagctataatacaatctctgcttaacgaaacagatcatgaggctgaaaacagaaatatgaatacacaaataacttcatgaaatcttaagtctctgaaagggcagcaatgtgtccgcttgttggctactgaatatcccccacccagatctcccagcacttaacaatgtcctggtacccactggtacctaaaaaatactgataaaagaaaggcaagaagcgtaaaagtaaaaagccagggcttctgagtcagaggcataaggagctgagggcctggaccggccacttagtaaccgtgtaaccttgggcaagttacttctctctgagtgtcactttctcatctgaggacaaagtttatggtgctggcgcacaatgatgtttaatgaaaaaataggcaatttaatgaaatccaacatttattgggcactatgtgccaggcacacatttgaacataatacgtgacacacatacctcctctaatggtcacaacatccctatgacatggatactgctactatgtctcccattttacaggtgagaaaaccgaggctgagaggctaaataacttgttgaaaggctacacaagcagcagagttagtatttcaacccagggagcctggctccagtggggcaagtacttgtcattacatgtttcttaaaactaataaatggaaagataatgatcgaaaattgaaacgagtcaaatggggaaaccaaggctcagggaagttaaacatgttcaacattgagcaataatgacagatcccagatttgaaccaggcagaacggcctcaggacaaaagcttgacgctgcatggccacgtggtttcttaagacttaacgaatgaaaaaagggatgaaagaataacatttccgaaaggccggacaccgcagaaggcacagaaggagaaactgagggaaatccagcttcggagcgcaggggagtccctcacccgcccaggccccagagcctcggggccgcccacgccgggatcccggcccaccttaccagcgcggcgacagcggaggagcgcccgggcctcctgcaccgtccgccgtctgccaagccgcgcctccagcgccgggtgccggtagcccttggggaagcggtgcttgatcaccgccgcgcggccctggaagcggccacggaacacgcgcgcctcggcaccctgcttcaccagctccaggccgctcaagaagcggctgctccgctcccgggctgcggccagagcctcagcctccggggcgggctcctcgccatcggccggcgtagtagctctggccgccgccatgactgctcggcgcaacagctccaaccgatcagctgtctctgaaaactgtcgcgatgcttcggctcgcttcggaaatcctgggacttcttcggcaatcctgggacttcttcggctacccgaatgcgtccaccccggacacttccggcctgtaagtggttacgcctcccaacttttcggctctctgaagcctgaggttccctgcaggaagggctcttgtggccccgccttccgcctcttcggctatctccgtacacgttcggcaacgctcagtaagtggctcttcccgactccttggctctccggaaatcttcggtgactctcgcagccggctttgggggcccacctctcagttggtcgtctctttccggaaaacttcggcgcctctcgagaaaaacgtcggacgcgctttgctctcttcagaagtctcttccgggacagctgtaccctctagtagtctctttttggaactcctcttcccctgactcctacattccccccaaaatgtgctcatacaagtcagagtcggaagggtcagacaatgaaccatgtttccgacatcctcttaagtgctaggataactaccatttagtgcattcagaagaaataaggttaaatgatgaaaatccttacagaaaagaaaattgagactcagagctggcagagggggtggtaagatggggtggggagtgggggctggggaatccgggaaagtcttccggagacagaacctaaactgaattgggaataattaaactttttcagtttctacctgtttcattacaaagcttataataacacaggctgtagcaaattcttacaatacggaactttgcacacgcacacataaataaataaactacctatcccccttgtgacactgctggccgttagtttctttccagaattttctttcattcagtgtgcacactcacacatcgttgtggcgttttttccaacataaatgacatcatactgtgggttctttggcaacttgcttttcattttcctaaacaatttatctcagactatattccatatcaatacatacagagctaccacgtccttctacctggtcaggcagtttcttgttgctaaacagttgtttccagtttgttgtttctcaggaaaacactttacttactattgccagtttattataaaagatagtataaaagataaaaatgaacagccagatgaagacgtacataaggaaaagtaaaaattgtacgtgtttatcgtaagtaacatgttttgaaatatgtatacattgtggaatggctaaatccagctagttaacgttacctaacatactgatcatttcgggggtgaggacacttaaaatctattatcttagcatttttcaagaatacaacccattgttattatctatagtcaccatgtcgtgcaatagatttcatgaatgtttcctcctatctaactgaaattttgtatcctttgaccaacttctcaaaatcctccctatctccctccccctaccccaccgcctggtaaccaccattctactctgcttgcatgagttcaacttttcttaccttcctcatataagtgagatcatgggatatttgtctttctgtgcctagcttatttcatttaacacaatatcctcctgttccatccatgttgctgtaaatgacagcattccattctttttaaaggctgaatagtatcccattgtgtatataaatgtaccatatttttatccattcatttagtgatggacactcagattgagaattgtgaatgatgctgcaattaacatgggactgcagacatctcttcaatatactgattttgtttcctttggatatgtacccagtagtagggttgctggatcataaggtagttctatttttattttttttgaagaacctccatactgttgtccataatgtctgtactaatttacattcctatcaacagggtgcaacggttcccttttctccacatccttgccaacacttattatctttcttatgttttaaaatagcgattctaacaggtcagaggtgatatctcattgtgggtttaatttgcatttcgctgatgattagtgatgttgagcatttttttttaatatacccgttgtccatttttatgtcttcttttgagaaagatttctttggatcttttgcctacttttaattcaggttttgtcctttcttactattggattgtattccttatatatttggatattaacccctcatcagatgtatggtttgcaaaaattttctcccattctgtagtttgtcttttcactctttttttttcttttttcttgactgtgcagaaacgttttagtttgatgcaattccatttgtctattttcacttttgctgcctgtgttttgagagtcctacacaaaaaatcgttgctcaggccaatgccatgacattttgtccctgttttcttataagagttttatagttttggctcttacatttaagtctaatccattttgagttgatttttgcatatgatgtaagataagagtctaaattctttcacatgaatatccagttgtcccaacaccatttatagaaaagactgtcctttctccattacgcgttcttggcatgtttgatgaaactcaattgactatagtgcgtggatttatttctgggctctctattctgttccattggtctatgtgcctgtttttatgccagtgacatgctgttttgattacaataactttgtagtatattttgaagtcaggcaatatgatgcctccagctttgttctttttgctcaagattgctttgactatatggagtctattatgattctatataaattttagaattttttatttctacaaaaatgtcattggaatattgataagaattacatggaatctgtaggacattttaacaatgttacttctccagttttgtttcatttttttttgttttgttgtctcttataaacagtgctgcagtgagcaggcttatccagccatctttgcacacatgaatgtttctgaggacatctttctacaggtgatattgctgggttgtaggtgacaagcactttgaaactcgactcctcagccaaactaccctcccaaagttttgtgcctatttatgcttcagtcaaattcatgtctcattttcccatatcttcatcttcattgagattctcaggtgctggaacgctcagtcagggggtggagagggagggtgctcaggttccaggcagtgagaacagacacagggtaggattgggttggacaaggaccagcagctccacatggctgctggcaggttggcactggggacaggctgggagctgaaagaacaaggacagtggcctggtcccaaaggatttctcttgctggaggagaggtgctgtgagcctggggtgactacaccaagcatggccctttggggccttgacctctggctgcaaaatatgcagctgagctctgggtagaacagccaagcagtaaaggggagggaggggtctactttttagccctttctgagcctgaaagagaacctatggcctcttcttcacttcccacccaccagcaccagatgcccattcagtgatttattcaccaattaatttaataaatatttattgagtgactactataggccaggtactgtgctaggccctggggacagagctgtaaacaaaatagagaataattattactgccctcatggagtttacattctagtgggtggaaaccagcaataaacaaataaggaaaatgtgtcattgacaggggctagcaggagataaatccagcaggaagggggatgggaaggatgacgtgcatctgggcttgccagggacagccccagtttttgcctgttgccctggcataactattattagtgcccccgccttttttttgagaaggagtctcactctgttgcccaggctggagtgcagtggcatgatcttggctcactgcaacctcaacctcccaggttcaagtgattctcaggcctcagcctcctgagtagctgggactataggtgtatgccaccatgcccaactaatttttttgtatttttagtagagatggggtttcaccgtgttggataggctggtctcaaactcctgacctcaagtgatccacctgcctcggcctcccaaagtgctgggattacaggcgtgagccactgcgcccaggctagtgtcccctttttactctcaaaagcattctagtttggatgatacaatatatggttaccctatgtgtagtagagtgggggtgggagggagtgatgcaattttattttattttattttttatttttatttttattgagacagggtcttgctttgttgcccaggctgcagtgcagtgatgcaacctgctggggctcaagcaatcaatcctcctaccttagccttctgagtagctgggaccacaagcatgtgccaccacccccagccaattgttaccattttttgtagagatggggtctccctatgtagtgcaggctggttacgaactcctggcctcaagtgatcctgttgcctcggcctccctcccaaacttctgggattacacatctgagctaccatgccgggcctaattttaaataaagtggttgagaaggtgtcaacgaaaaggtgacatttgaaccctgtgaatggattcctgggggaagatctttccagacaggagaggccccagagaggaagtgtgcttgacatgtttgagtaagagtgagttatttaacctctctgtgctttagtttcctcatctgtaaaagaagattgtagataatattcatcttgtagggtttttgtgatgattaaatgtgtaacaaggtaaaacacatagaaccgtgctgggcacatgatatgcacttcgaaatggaagctattattattatggagtgtttagtatgatgacaattaaaactggacccccagtatccaaccactgctccttgtgggggaaggggcttcccattgtgtggtgtctcggggaacacagaaaccacctcccactacagaagcctctcctttgccccatccttgtgtggcttgcaacaagaaccctgacttgtaccaccactgagtggaggtgtgttgtaactgtattaattagctaggaaacaaaataaactgctataacaaagtaacctacaaatactggcttaaatatgagagagatttatttcttgcttatgaaacatccagatctgttattctcaacttattgcttcctcctctgagtctactccacttgttgccctctccactcagcaaaaagggtgatgacaaccaggaaaaagagatcaaccagctaagaacttggcccaaagttgcacatgtcacttccactctcatcctattggccagaacttagtcacatggaagatgcaaaggaagctgggaaatgtattctttagcagggcggacacgaattcagctaaaaccctgggtgattattactaaaaggaaggaggggaggaatgatattgggggacaattaatagactgcaatggttttgatattttaaactgcaagtaacatcagtcaactaattagcttaattggcataaacaataagttcatttattatctcccaaaatttcaagaggtgtggctgggtgcagtggctcacgcctgtaatcccagcactttgggaggctgaggcaagtggatcacctgaggtaaggagttggagaccagcctggccaacatagctaaaccctgtctctactaaaaatgcaaaaaatttgctgagcatagtggcatgcgcctgtagtcccagctactcaggaggctgaggcaggagaatcacttgaacccaggaggcagaggttgcagtgagccacgatcacaccattgcactccagcctgcacaacaagagcaaaactccatctcaataaataaataaataatttcaagagatggaaggtcccagctgtcattagataccaaggacatggggtcctttcattcttttccaccagcctcagcatgttgttttggtccttatccttgtcaccttatgatctcaagatggctatcaaagttccacacattatctgaagacacaaaaacatttggttcaagaagaggggcagtacctcctgtatagttttctttatttgggagaaaatcctttgctgaagcctcttctctccccatcacacttcccataaagggcatcggtcatagttggcccatgtgcctttggcttagctacagaggaagctggaaaagtgaggatctggcatcttcagcctttgaagatggagatgtgttctataagcaacgagcaagcgagctgggcatagctattggaaaggcagccacaaatggctggcacactgtgacgcccaccaacatcatttttctgtatttcagtttaatcatcttcagaatggggataattagttctactttggcaagtgcttataaaaattaaacaagatgttcaacataagggtgcctggtggatagcagacactcttcatttgttcattttccttccttccacccactagtcactggggccctgtttgaaataccaaagaaaagccctttggtctgagggttgctatgacaccaatgccttgggctctgcagtccttaggtttcattcacacacgaggcaggtcgctttttcaaacataagatcctttatgttggcataatgtggtttctagcacctttcatcagcccagactactcaaagcctacccagaaccaattctatttataactcccagtttcccaagtttgtggcttcattatcataattgttagtgtccacgtagttgtctctatggttaccaaattcatctgagcctctgccttagaaatctgcatgaaaacatatttacaagacccaggcttgctatggtcagactggttctggcttctgtggcaggaaactcaatttaaagcctttcagtggctccccactgcacttaggataaagatccaatccttaattcagcccaggaggccctgcataagatccctgcatccacttccaaacttatctcccgtgaaactcccccttctacttggtctctgctttttttctttctttcttttttaagaaacagggtctcactctgtcacccaggctggagtgcagtggcatgatctcagctcactgcagcctccaacctcctggtctcaagcgattctctggcctcagcctcctgagtagctaagacttcaggcatgagccaccacacctagctaatttttgtatttttttataaagatgggtgtcttactatgttgcccaggctggtctccaattcccagacaactgtaatatcaagaaacaccaggagaggagtgaggtaaggacaggaaggcagtcagtgaaaggtgagcccatttccactctgggcaactagagctgaatcccactggggaacagaagccagtgtagatgactcaggcctcagacccaaggggcaagggacctgggtacttagacagcagtcgttgactgagggttgttcccaagagatgttactttctctgtgctcctggcctgccacaaagcagcagagcaggggcagagagagcccaaatgcagatgccggcttgactgtcagccatgtgcagtgaagggcaaggcatccaggggactgagcatagcactgccagtgactgcccaatggggatacattttgcattattcatcgccatggtggctgcaaatgacagaaacaagcttaaccacaaaaagaaatttattttaggtgcagctggacccaggggctcacaggatgtatctggctgcctctcaacattgctttcatcttcaatggctttatctccaggagtgctccctttctcatgatgagctccacatcaaccagcccagcaaccccagcagaaagaacagacccttctgcactggtttctcattgctgctgcaacgaattgccacacacttagtagcttaagtgacatttttttttttttgagacagggtctcactctgtcatccaggctggagtgcagtggcatgatcagggctcactgcagcttcaactcccccctacaagcccaagcaatccttctgctgaaacctcccgagtagctgggactataggactacatgtgtgagccaccacgccctgctgatttgttgtatttttagtagagattgggtttcgccctgttggccaggtctcaaactcctggactcaagcaatctgcccaccttgtcctcccaaagtgttgggattacaggcatgagccaccatgcccagccttaaatgacatttattatcttacagttctagagatcagaagtctgaaatgggtctcactggggtgaaattggagtgtcagcagggctgtgttcctttctgggggctttagggatagaatctgtttacctgcttttctaatgtctaaaagctgcccacattccttgtctgatagccccctttctctgtcttcaaggccagcaacatccggtcaattccttctgtgtaaggacactctgtgttgctataaagaatacctgaggctgggtggtttatagagaaaagaggtttattttggctcatggttctgcaggctgtagaggaagcacaacaccacatctgcttctggtgaggcctcaggaagcttgcaatcatggcagaaggtgaaaggggagcagacgtgccacatggtgagagagggagcaagagagaagggaggaggtgccagtgggctctttgaacaaccagatctcacatggactaatagagcaagaactcactcatgaacatgcagaaggcaccaagccattcatgagagatctgcccccatgacccaaatacttcccattaggcccctcctgcaacattaggggtcatatttcaacatgagatttggagggaacacacatccaaaccatatcgccttctcaggctgccatctccccagctctctctcctgcctccttctacttttaaggatccttgtgattacattaggcccacccggctaatccaggataatctttccaaaatctgctggctagcaactttatttttttgagatgaagtcttaacttactctgccacccaggctggagtgcagtggcctgatctctgttcactgcaaactccgcctcccagattcaagcaattctcctgccccagcctcccgagtagctgagatgacagacgtgtgccaccatgcctagctaatttttgtatttttagtacagacggggtttcgccatgttggccagggtggtcttgaactcctgacctcaagtgatctacccacctcggcatcccagagtgctgggattataggcgtgagccaccaccgcacccggcctcacaactttaattctatctgcaacctgaattcccctttgccatgtggcctaatatattcacagtctccagagatgagaataggaacgtctttgtggattgttattttgcctgctacactattttcccccaacagttctagcaaaaatccaggatcaattttcattggtctgccttgggtcacataactgtttctgaacacactactgtagacaaagcaatggaaaagactgattggccagatctggtcatgtggaaaggggaggtggagccagccccattggaattcacatggagagtgaagaaggtgtggctccccaaaggaaaatctgagtggtcttaccaggagaaggtataatgaatgtcaggcaggcaaaagtccgggatgctcactacaggtcagcaggccagaatttcttgttgtgggaagaagatgatacatgtttagaattgtaatgttgtaatgttgaattttaaattaaaagaaaatttcggcactgttctgggtgataacaagcctccatcactgcaaacctccaataaatataaccacatacattgcctagtgcacgactccaaagttgtaagaaaaatcggacaactattacaggcatgaagacgagcagtgatagggaattaggcaagagtacagggaaaaaaagcaagaagtgattaggagaaatttcagcctcctccatccaccctactcctagaatccagctccagaacattagatttccctttatatgagtgtagtgggataatatatttttaatgatgatttttaaaaactacatctttatcccattactgttgaaacatactagaaatgatttggttcatttgtgaataacagaaagactcacaatagcagtgactcaaacaatctagcagtttatctttgaagtacagagacagtggggccaggcctgaagtggtacatcacggagttaggaacccagattgctgctgtggggttgctctgctgggttcagtttctactctcaaggtctcatggcacaaaatggctgctggagctctgtcaatcatgactgcattctggctggctttaaagacacttccaataaatttcatgcagtacctatgcttatatccgtaaccatcatgctacacgcatacatttaacccagtggttctcaaacggaagagattttgcctcccagggaatatttggcaatgcgaggagcagggagtgtgctgccctctagtgcgaagaagccagcgatgctgctaaacatcctacagtacagagcatcttcctacaacagtctttcagtccaaaatgtcaatagtgctgaggttgagaaacctggtttatcctttccgagcctcagtttcctcacttatctaaatgctgggaacagagaaatgatcaaaacagagaaaatgataaaacacgggacacaggggaggcttcctcagattaattatacaggactcatgagttcttacggaattcaaatttgatcaatcacgtgaaggttttacaaactaaggcactactaggggacaaatctgtgattgtttcaagtcagctgagtagcgttcagtgacagtggagcaggcagagcagggataaaggactatttgcaatggttcaagcctagtatttgggaaccagaagggaagggatagtgcagtaccccagagagggtaaccgtggagctgtcaccatccttgagccacaggggtgaaggaaggagtaaaaggagaaagtcatatagagaaaaggttgtttggagaggagcaaggagcaatgcactaggagacagaaggcctgggtcacatagtcttgcagaagtccccaaaagccctgcgtatcgctcgtcacctctgccctcgtctcctatctctcttcccctcattctgctccagccatcctggcctccctgctcttcctcagacacactcctgcctcagggctctggcgcgtgctgtttcctctgcttggaatgctgatcccacaggtatccttctgcccattctctcacctcattcaggtcttttcccaagtgtcaccttctcattgaggacttcccaaaccacctgattaggaattggcacactgccattcctcttgcaactttgatcctctttccctgctttatttttctccatactgtttatcattatctggtaccttatacaatttacgtatttatcttgtattgtattgtattttacatattgtaaaatatgtaaaaaatgtaaaatctgtcgtctgtctccctttattgaatgtaagctccatggagacaagagtttttctctgttttgatcatttctcggttcccagcacttagataagttatcagcataataaatactcaatatatacctgttgaattaataattaaatgtaagaatgaatgaatttattcattcataaaattaattgttcatgaatctcattaattattcatgaagtaattgaatcagtaaaccactcctcttccatgtgaatcagaactgactcattagcatactccaccggctcccagcctggccaatgagactcaattctgagactttggagagagctctttgaaaagacaagctctctttataccaaggaaaataaactgtgaggatgtgagtctgggactacccagtaaacctgcctgagagggaacccaaaatagaagaagcagagaattacagagatctgatgaaatcatttaaccctggatccggccatgcctgaagcagaattttaaaatatatgttaaccaacaaatatatttttttcttaagctgctttgagttaggtctctgtaacttgcaactgaaagcatcctgactgccaggatgagagatgtggagcagagatgatttgcagaccaacgagagaatcagccaaatagcagacatgggagagaagagcacagatcctgggaaataaatacatatttttctatgcccctgaggttttgtgggaatcttttgttgttgttctgtttatttgttgtgtagcaattttgtggcaacagttaaccatgacgaataccgtggggcaaatggaatctgtttggcccaacatcagccttcccaatgactgagtcaggtttagaggtgctctgctactctgggcaggatgtaggacatgggacacaggggaagctttgttgaggttgtctgtgtcctagccagttaacttgatatggattctggtgtcctttgggttgtgtccggtttgctaacaccttgtttttaaaacataatatctcctgcttcattaaaaaaaaaatcaggaaagttcacgtttcctataatgaaaaatattagcatcaggtccacattcctacctagccagcctgctgagctccacccagctgtccctgttagtcctttttttttttggcaagggtgggggtggggggtggggggtgggggcagggtttcgctctatcacctaggctggagtgcagtggtgcaatctcagtacactgcaacctccacttcctggctcaagtgatccttcagcctcagccccctgagtagctgggatcccaggcacaagccaccatgcccggctcatttttgtattttttatagagacagggttttgccatgttgctcaggctggtctccaacccctgagctcaaagcgatccacccacctcggcctcccaaagtgctaggattacaggcatgagccaccccatctggcgccctgagagtctcgacctgtggttgtcaaactttttctgaaaggccagatagtaaatatttaaagcactgtgggccataccatcatgtctgttacaactactcaactttgctgttgtagtgcaaaggcaaccatggacaatatggaaatgcacaggcatgactgtgttcgaataaaactttatagacaaaacagtcagctgattgtagtctgctgacttccgccctgaatgaacagccttcagcttgccacagtcctcaccactccgcactgccttatgcccggctcacttccctcacttataacacctcagtgggccctgtaggcgtatgaatttgcagcctctaatctaagttctttttaaggttagagtttggggaacaaaaaacaggcagtcttgtaagctggctgcttgggtgaacaagaggaaggtaaaatccttcaacaattatgatttagcaactagtatgtgctaggtgtaattctagatgtttatcctgaaccaaaacactgggatacagaagagaaaaagggagatttaaaaaaattcctgaccaggtgcgatgactcatgcctgtaatcccagcattttgggaggccgaggcaaattccttgagcccaggaatttgagaccagacagggcaatgtggcaaagccccatttctacagaaaatataaaaaaattagcccaatgtggtggcacacgcttatagtcccagctacttgggaggctgaggtgagaggatcacttgggcttggggtggtcaaggctgcagtgagctgtgattgctctactgtactccagcctcggcaacagagcgagatcttgtctccaaaaaaaaaaaaatcccactcatagagcttcattttaagggagaagacagagtaaacaaataaatgagagatataatgtgttaaggataatagatatgttccttatcttaattgtgatgatggtttcacgtgatggtttcacaggtgtaaatgtgtgaaaatttgtcaaactatacactttaagtatgagcagcttatcatatgccaactgtgcttctgttaaattaagtttagcctgaagctgcctccttacctatttctagttcagcctaaaggtttccctgtacgtgatgaaccatgacctaactagatgtgtaaacagactacaacttacccttgcaccagtcaccaagttttggccaatcagtggtggccaactgttcaaactgtgttcaaataagacaaatgccaagctgtaaccaatccaattgtttctgtacctcacttccgttttctctatgtcactttcctttttgtgtccataaatcctctccaaccatgtggtaacacctattctggttcggggggctgcccaattcacaaattatcctctgctccattaaactctgttaaatttaattggtccaaagtttttcttttaatagttcaataaagcttatatatatatatatatatatatatatatacacacacacacacacacatatataaagaaatgaagaaaaaaacaactgcttatctagaaagataccaaaatgtaactaggtttttgagttttgttccaaatatgtattatttttaacatatgatgttctttaatgtgtcatatattgctattttaataaagagctccatttttgtttctgtctttaaaaaaagatatacagtgtatcagatggtgataagtacaacagatagaaatatgcaaagaagagatatagagagagttggaagggggttataaatggtaaatgagaagacagagaaaaacagtaattaagatctcacagtggccgggtgtggtggctcacacctgtaattccagcactttgggaggctgaggcgggcagatcacttgaggccaggaatccgagaccagactgcaacattgtgaaacccagtctctactaaaaatacaaaaattagccaggcgcggtggcaggcctctgtaatcccagctacttgggaggttgaggcacgagaatctcttgaacctgggaggcggaggctgcagtgagccaagatcgtgccactgcactgcagcctaggtgacagagtgagactttgtctcaaaaaaaaaaaaaaagaaaagaaaaagaaaaaagatctcaaagtaagctgggtgtggttgtgactataacaggtctgttgcttgaagcagggcaagtcaatacaccaatacagagggttgcggcagagaaagagttaaaaaaaatcttagggcagctgaatgaggagacagaaggaaacctcaaatccacctcctggaggagtttcagccttgggattttaagggttttggagtgggctgaggtatagggatcgtcgtttggttgaagaatgcagagtgaagtcacaggacagggagataaagaaatttcgttcttaggctgattcagttcctctgtgggggtcttcaaactggttggtgtctgccggtccactggaattcaggatctgaagaacatcttaagcaattcctaaacaaaaagccttatgatgcaaaggtcagaaatcctatctgtaggaacaatggggatgcaaatggcagtatctagtgccacatgactttcagttacaaggaagtgggccaaagggcagccaaattaatgcttaattataactatgtttctgcccagaacccagcatgtaattctagttaaccctatgaggacaatttcatggcggcacatgcctatagtctttgctactcagaagactgaggcaggaggatcacttgagtcaggagttagaggctgaagggcactatcctcatgcctgtgaatagccactgcactccagcctgggcaacatagtgagactccatcgcaaaaaatacaaaataaaatctcaaagcagaatccacttacaaaacaaactctaaatgtgcaagttatactccctttctcagccctaatccaaccctccatcgtgccctcccctcctcactcctgctaaacttcagggttgccgacagctgagtttaagctccatgccctgctacatgattcacagctgaagcctccttctgggtcttgctgtcttcatcctgcctcttctgatccatcccgacagtcccagggaagtgtagttgttcctggtctgttcctcattagctgtgtcgaaagacaaaatcacaagtttaaagatctcagttggctttatttacaattctaaaattgggcaacacttcgtttcatcaaatagaataaatgttccagtaagctgagaagcagaggttggctttataaagacagagaaggactgaagaaagcagaaacaaagaacaaaaagtatattagttactttagagcaatagaaaaataactggttaacatcaggttacttcaggctaccttttttgtgtaaggatgaaagcagagggaacttcatcatcacactgattgaagatttaagctggctgcttgtctctctcctgatttctggaaaggtcagataacaacttagcttaggttcagtgacctggaactctagcatgggtgactccattttgattttcagtctgttctgttggggactagtgcaggagcttagtccaaaacaatggctggtaaggttgccagatttagcaaaaacagcaacaaatagtatgcccagttaaacgcgaatttcagatagacatcaaataattttgtagtaaaattatgtcccatgtttatctgaaattcacatttaactgggcatcctgtattttatcctgtattttatctaaattctgtgtcactccccaagaaatcaacttgggttctgaggccatctataaaaggaagtttattaaagtggctttttaagggaattttttttttaaatcagagaaactcctttttccatgatggaccccaagctaatgaataggcttttaaaatagtgagtgagaggtttacaacacttaagagacagacattggtgagaagggcttttcagcaaagtcctataattgctgaatgggttcttcctgctcgctgcacagacaaaaccagttcactgagactgcagtattgcagtagagaaagagttttattaatgcagagctagccaagtgggctaggtggagttattcctcaaatcagtctttctgaaaacttcagaaaccagggtttttataaatactttggtgagcagggggatagggaatgggtgctgctgattggttgggggggtgaaatcatcgagatatggaaaacagccccgtgcactgagtctgcctctagatgggagccacaggaccagtccactcatgaatctttagtccaggcggggtcagttggttgccaggatgtgaaagtatgaaaaacatctcaaaagatgaatcttaggttctacaatagtgatgttatctacaggagcaattggggaaattacaaatcttgtgacctctggccacatgactcctgagcagtaaggaattaccaaaactacacctgcattttagcataattcaggcccatcccataatcctaacctcatggactttcattaattttacaaaggtagcttcagtccctgagcaaggagggggttagttttagggagtgattattatcatccttgcttcaaagttaaaatataaactaaactcctctcgtggttggcttggcctatacccagaaataagcaaagacaggtagccggtgaggtcagagtcaagatggagtcaaccatgccagatttctcttgctctctaatctttgcaaaggcattttcagtcccttaagatcacattaaattaaagttagataccatcctcaccgatttctcagcttctgatggttaactgttcaagggtcagaggagagattcaaggccaagggtgataagcctcctagtgtccatgtagatataacctaatctctactttctcctggagatgatccatctcctttttctaatcaagataatgaacaataatgaaatgtgtattcgttatttatcactgtataacaaattattccccaaatttagtggcttaaagaaacaaacatttattatctcatgtcttctaggataaagaatttagcatagctaaattctagctctgagcaagagctcagaatcttgcaaggttgaaatcaaggtgtcagccaggactagagtcacctccaggctaggctgagggaagattcacgtccaagctcaccacaagcttgttggccagatttagctccttaggggctgttgatttaagggctttagtccctcactggttattgcctggaggcattagctatgtgattcaatagcttcgctccatgtgggcctctccattgggaagctcaaaacatggcagctcaattgcttcatcagagcaaacaagtgagagatctcgaaactgaacaacacagaaatcatttataacctaatccgaaaatgacatccaccatatttgccgtcttctattcattagacgttgctaagtgatacttctagtgacatctagaagagaagaggatgccactaggccacgaataccaggagggtctcagtgtaatcagactttttatatgaaggctcagggatccaggcaccagtattccagtgacccagcctcagaagttacacagtgtcactctgcaggctactgatcaaaccagtcacaagcccacttttatttcaagggaaggaacaacgaattctggagccatgttttcaaactgccccagctattattatttttgaaactgtgcaaggatcccctggttcagaggtcttatggatgctgtcatctttgctgagatacctgcttgtgccttcagcatggaagaatgcctgtgtatccacctgtacggtaggggtcgctgtgactttgactggtgagggtacagccactggtgcacatgcaaaggtgcctatctgtgaacacgtattgagaggctggataaggctgcgcccatgtgagtgctgggcttgtacgtgcatttttgcctgagtgagcattagtggcagtgtccccagcctacccctttcctgaatcccaggctcatagccaactgcccacctatttccacgtggatgcctgctgagcacctcaaatgtcacacagccaagacagaactctggatctcctttcccagccacaagctgcccctcttccagtctgtaagttcttacggagcatatatatgtgatctgcctacttttctccaacctcaccacagtgacatgagcccaaaccaacttctcaccttgcaacagcctcccaggtgggaaggctgagtattctggcccttaaccagttagaactccccagttatctgtcctgctgatggggttgaaatctacattcctgaccctggcccaccaaagcccctcccttagctcccatctccctcctctctccctgtcttctcctctgctccagacactctggcttcatttctgcgttttttgtaccccataagctccttcccaccccggggcctttgcctttgctgttccccctgcggggaatgccggatctctgctcagatatcctcttctcagatcagcaagctaaagcagccacctgtgtctgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtggtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttctaccagggaggatggcttgctggtgtgtcccccccaggggaggactaccaacgaaggggacccgggagatggcgggtgggggcccccgggaggacagtgggcgagggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggtaagtcccgatcgggcgctgcctgctggaagcccgaccccttcccagggtgtagacaccgcccccacgctcccctaagagtgcgcgccccctggctcccccagggccgccccggccggataccgcctctcgggtggccagcccgagactgcaggcctgcggcgggggctgggacggggctcggtcgcgcttccttccatcttcctttctgccccggaaaagtggcccctcacttgctgcagcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcctggggacgctgtcgcgaacgaaactgcgaacaaaacagacgaaccccctcctctggacgtgattctgcagagaggggacagagaaggagattctaacacagcattggggtgggacgcgtggggaatggctttgttgccactcgggactagggctctatttttctctctgcattcagaagcctcgaaggatcagtcgttgattcttgagtgagcacctactacgtgccagacattgatataggggttagagcttcagcaatgaacaaaatagacaataaacctctctctcatggaggtggcattctgattgagcagctgggtaaacacgtttatgaataacttcagagagagataaggtgttgtggaacccataaaatggggtggcgtgaaggccaagggcgtgggttccttgggtaggtggtcagggtgggttttctggagtaggacgttttggagctgagaacttcctcagaagcgggtcttgctgagatctggagaaagagcttccaggtggcagcaacagtgcaaaggccctcaggcaggaatgagtttgtgtggcccaggccaggatggccagagcacagcgggcagggcactgaggtcaaagggatggcagagaggtgtgcagggctttgtaagccgtggtgagaagttcagattttattgcaaatgccacggcaagctggagaagggttttaagctggagcggggccgtgacctgaattatcttttcttttttttttcttttttttgagatgatcactctgtcgccaggctggagtgcagtggcgtgatcccgctcactgcaacctccagctccctggttcaagcaattctcctgcctcagcctcccaagtagctgggattacaggcatacaccaccacgcccagctaatttttgtatttttagtagagagtgggtttcaccatgttggccaggatgtcttgatctcctgacctcgtgatccggctgcctcggcttgggattacaggcgtgagcctccgcgcccggccctgaattaacttctcaaagtttgctctgagtcgttctgtggagaatcacagtcgctaacactggctatgatgtaggtaagcatagaaggtaggcattaatatcccatttgtagatggggaagcccagagaggtgaggtgagttccccaaggtcacacagctatggagaggagaagctgggaaggagccccagcattctgactccagtctgcattcctaaccactgcaccacgtggcctgtcatggtggattaatggtaaaactggtgaccagttccggctctgacaggagagtccatcctcttaacccccacagcacagtgccccagagcctgagaaaaaaatgaggcccagagaggtcaaggtcttcttaaggacactcagcttagccctagccccttgttcctgcacctcctattcctgctaaatcaacccaacagccatttgctgagtgccttctatgggcagagcgagggctgggtgttagtgctgggggaggcataagtcatggctgcgggtctctgtcctccccagaattcttacacagcagggaccagggattgggctctctttatagcctctgggggcagaactgggttctagacccaattcctctcactttgttccaccattccactttgacctgggagagtctgccaacttctctggtcactatcaaatacccttatcacagggtagccatgagaatgatgtgaaaaaatgaattacagtgctcggctcatcacctatatctggtaaatggtgagtgaatgtgagtttttattttatattgcacccaatattgggattctggagtcagactgcccgagttcaagttcctgctatgtgacttacaaactgtgccaccttggggaaatgtcttcacctctcagtgtggtggttatttctgtaaaatgggaatgacaatagtgattgtcataggattgtctagggattaagccagctggtacagatactgccccttaggagagtggctggctatagtgggtactccaagtatcagctgtggctgcaattgctgggacatttggaagccggccatctgcaagaggatattcatacagttcaatttcacatctggcttctccctggagcttcagggaaagccacagcaggtctctggtgcaggagggacccagtgctctgtgacctctggttgagacactactctagtgtcaccaacgggaggcctaggacttgcagctggagatacttgcatcccaaaccagggttctcccccctccccctgccccctgaccctgtcccggggaagctgtgccctccacagcgaggggcttagaggattaagggatttcctccagtgtgggacatcttcactacagcctatgttaggcaggttattaatagaaaggatgcacacttgctaaacttaggtcaagccgtcttaatgtgttctccttaattttctttcttttctttttttctctttctttctttctgtcttctttctttcttttttttttttttttttttttgacaaagtctggctctgtcatctaggctagagtgcagtggtacagtctcggctcactgcaacctctgcctcccaggctcaagccatcctcccacctcagcctcccaagtagctggaattacaggtgcacaccactattcctggctcatttttgtattttttggtagagatggggtttcaccgtgttacccaggctgatcttgaactcatgaactcaagtgatccacttgccttagcctcccaaagtattgggattataggcatgagccaccgagcccagcctaagacatcttaatttgaggacgaggctttgctctgcttcctgtccatggccacttccaggccctggacctttcagatgttcatgagccaagatcctttctttctggatttcctacatccccacagttcatttggtttttcattcattcactcaatcattcatttgtttaacaaatattattgattgagtgctgagtaactgtccttggcctcagggagacagctgagaagaaacaaaccactcctgttcccttgaggctgactttcaggtcagggagaccaataaatatgtaaaatatgtagttattttggaagatgagaagtgccacgcagaaaaaacaagtggagaagggaatacaaagtgctagatgctacagggaggttgaattttaggtagaaggccagggacagcctcaccgagaaggggatgtttcagcaaagatcagaagggaggaaggaaggaactgttggcatggagggacaggacttcccaggcagagaggctggcaggtaccaagctttgagttgggacgtgcttggagtgagagtagcagcaaggaaccagtgtgactggagcccagtgagagggggcagatcctgcagagtcttgaaggccacggtgaggacgttggcttttcttagactgaaataggagccttggagggctcctagtggaagagtgacgaggcctgacttaggttttcccagaatccttctggctgctgtgtagaattagtttaggttcagaggtatctgacacagccctagaaatgtcatgaggtgaaatagccctggtcctctacccagtcatttgttcattcagcagaaacttcactgggttcctcttgggtgtcagggcagggctggggccccggaggctcaggacgagtcagtctctatccctgccctccttagttgaatatggaagactcataaaggaacttgcagtgtgaaggaaaaagagtacagtggagagttgaggaagatgcatgggaattggtcaggaactccctcaaacttttccactgaaaggcactaagcaaacatcactgtctgctgataggaagggtacttgggtactgagattaaaaaaaaaatgacaggccaaccttcagaaaatccagaaattggcaatgagtatttatgggtcactgaagtctatggcttcaggtgcagttggatctaggggctcatacagtgttgtcaggaatccttcattggggaagatggcccccagtggctccaggcaagtaaaacaccagcttggcacccctggtgagcaaacacacccggtccgactctcactggcccaggttcacccacgtggtattcacctctgcctagggcccaggaatttgctgattgattggatctggatcatggacaccaccctggggctgggcactgagggtggaggtgggggcagtcatctccacccaaaccaggagactgtgagacaaggaaaaggggcggctccctgcaacggaagatgaggagcggatgccaaataacagatgtgtatacctggaggctccttggggaggtggcacaggacctgggactgaagagggagagtagaggaacaaggggaccctttccttggggaacaaggacagtgcacgtaggaggcccagcacgtgcagtggtggagcggcatgaaagcatacagtatgtgccgggaacaaacatgttggcaaggtgtgtggggcggggctgtggcgacagagtccgggaggaggcgaagtggctgaggagttaggccagcccatgaagggccttgcctgtcatgctaaggtggtgggactgactcaggtgatgggaaccatggaaagggaatgttcttcctcgtcttcctaatggctccaactcctttgaggtcctcctttatatctacagtcccatgccacagtatcatttcaccatgctttatcccttggggttttcctgagagctctttcccctccacctctgcctcctgcaccccagtttcctcccaccgcacctatctctgattgactcttcttgctgggaggtcagtgcagcggagctcttaaggacatgggtttgggaggcaggcaggtcagcatttccatcctgatcctgttgcttcctagctgtgagaacactctgagccttaacctccacatctgtaagatggaataattgtagcagtctcacctagggttgttatgaggatgaattgagggaaggaacataaagtcttcacacagaggaggtctccatacatgatagctgttattattactgttttatttcacgtttgtttgtttgtttgtttgtttctattgtccattggccttattgtccatttcaactgaacctgcactgatgtgttttccagtggaacctgtgggtggaagctgtgagccctttggctgggttccctttcgctgcaagaggaacccaggaaatggcaaacaaatcctgggctttcacctcgattgcttcacatggcctggaaggaccttgctttctgggaaaaagcctcaggaatgagggaggaggggcaaaggggggcgaagacagagcaggatctgagcagcatcttccaggatgtttactagtggtgaggaacaggaaggacaggccagccagggagtggcaagggctcgtttccttggaaggtaggagtggcaggggagagggatgagcagaagtgggggtggagaatgattccttcacccatggaactcctccttctgcacaaaaactgcctaacaaagctaagaagggacccaagcaagagaacagagtgaaatcacatttcaccaaggttttataatggagcagtcaagagtagggactgtggacccagacagcctggctttcattctatcctcagctgcttacaactttttttgtttttttattttagagtcagggtctcagtctgtcacccaagctggagtgcagtgtcacgatcatagctcactgtaacctcaaactcctgggctcaagcgatcctcacacttcaacccctagagtagctgggactacaggtgcccaccaccctgcctggctaatttttaaaccttttgtatagagacaggatcttgctatgttgcccaggttgcacttactacttttgaccttaagtgagttgctttacccccctgatgatcactttattcattcgtaaataatacaagagcctacctcataacgttggggtgagaactttttttttttttttttgagacaggatcttgctctgttgtccaggctggagtgcagtggcacgatctcggctcactgcaacctccaccttcccggattcaaatgattctcccacctcagcctcccgagtagctgggattacaggtgcatgccacacacccggctgatttttgtatttttagttgagatgggttctcatcatgttggccaggctgctcttgaactcctggcctcaagtgatccgcccgcctcagcctcccaaagtgttgggattacaggcgtgagccaccacacctggccataaatgtgtttttaaactcaaagcaatgtctagtccagagaaactctccatacatctggctataatattgcagatgtccttgtcaggtccagggtgggggtgcatgacatagatactgctggattattctagatgcttccagaaatatataaatttaagtgtgtgaattaaaaattaagagtaatctgtgcaactgtgctgccaatagggtagccagcatccatatgtggttatttttatatgtacactaatataaataaaataaaataaaataaaaaattcaggctgggcatggtggctcatacctgtaagtaatctcagcattttgggagactgaggcgggcggatcaccagaggtcaggagttcgagaccagcctggccaacatggtgaaacccggtctctactaaaaatataaaaattagccaggcttagtggtacatgcctgtagtcccagctactcgggaggctgaggcaggagaattgctagaacccaggagatggaggttgcagtgagccggaattacgccactgcgctccagcctgggaaacagagtaagactgtctaaaaaaaaagaaaagaaattatttcctgcatcccgttagccacatttcaagggctcattttctacatgtggttggctagtgactatcatattgcacagcatggttatagaaatttctgtcattgcagaaaatgctgtcagatagtgctgctctaagaagaaaggaaaacatagaaaatgtaacactcagatcagtgcgggaaaaaatggaaaaaaaacccaccccataattgatccatcaaaagcagaaatggaggtaaaaagaaatatcctgatagcacagtaaatagaagacaaaaagataaatggcagaagcaatttcaattgtatcagtcattgtaataaatgtggaccagttcacctttttatttatttatttatttttgagatggagtcttgctctgtcgcccaggctggagtgcagtggtgcaatctcggttcactacaacctccgcctcctgggtttaattgattctcccacctcagcctccttgatagctgggattacaggcgcccaccaccacgccaggctaatttttgtatttttagtagagatgggttttgccatgttggccaggctgttctcgaactcctgaccacaggtgatccacctgctttggccttccaaagtgctgggattataggtgcgagccaccacacacggccaagttcaccttttaaaagaagacagtcagattgcatctgaaatcatccagctgtatactgctttcacaaggaacacatgacaaatggttacagatctaacctgttgggttaaagtgctttgaaaatgcagacactgaggagggagcgctcactgtctaaatgtaggtgcctctggggtgaacaggtttcagaaggaggagacaatgtgagttgagaaaggctaaatctaactacagctgttgaaaataccttgactgccatgcatggtgactcacgcctgtaatcccaacactttgggaggcctaggcaggaagatcacttgagcccaggagttcgagaccagcctgggcaatgtagtgagaccccacctcttcaaaaaaatcaaaaagttagcctggcatggtggtgcatgtctatagtcccagctgcttggaaagctaaggcaggaggatcacttgagcccgggaggcagaggcagtgagccatatggtgccactgcactccagcctgagtgacggaacgagacctcatcttagaaaaaaaaaagaaagaaaatgctttgagctttctttttcctgtgtctgttcttatggcgccttcattattccctgtgttgtttggatttctgtcttttctccttatttatgcttaccaaagcattatctgttttcttatccatgtcaaggaaccaacttgagttttagcgatcaactatcctcttcttgtcgtttttccattcccttaacatctgttttcatattcactaattccacttgctctttgggttcattttgttctaattttcctagcttcttcacacaaagacttaattaatttactctcaggttcttttggggttcctgataaaatataattttcacttgattatctctttgaccacatcccacaggcccattttttatgtgggccttttattctcatttcattatttattacaatttttattctcagttatttttatcctcaattattcaagatttttaatctttattttatttattctcattcagtaggtggttatttctattttgtttcttctttatgccaagtaatttagatgtatattttatattttattttattttttaaagatagggccttgctctgtcacccaggctgggatgcagtggtgtgatcatagctcactgcagcctcgacctcctgggctcaagcaatccttctgcctcagcctcctgattagctggaactacaggtatgcaccaccacacccagctaatttttaaagaaaatttttctgtagaggtggtgtctcactatgttgtgcaggctggcctcaaactcctggcctcaagtgatcctcctgctttggcctcccaaagcgatgagattacaggcatgagctaccacattcggctttagctgtgtattttaagtttctccatgtatatttgggcggaggggggtgttgttgttactggttgttttttttttctctctgaatgaaaaagccatggttggaaaaaaaaaatgcttgtctgcaatgccaggaaccaacaggcttagttttgctatttggcctgttccctttgcactagatctgcagcaaagagtgaaatggagtcagcgtcttcttcctcttattctcttagcaccagctgttgaagggttatgttttgaaggtgtattagtctgttttcatgctgctgataaagacatacctgagactgggtagtttataaagaaaaagaggtttaatgaactcacagttccatgtgtctggggaggcctcaaaatcatggtggaaggtgaaaggcactttacatggcggcaggcaagaaagaatgaaagccacgtgaaagggattccccttataaaaccatcagatcttgtgagacttattcactaccacgaaacagtatgggggaaccacccccatgactcaattatctcccactgggtcccttccacaacatgagggaattatgggagctacaatttaagatgagatttgggtggggacacagccaaatcatatcagaagtggagcaggagatgacatcaaatttgtgttttcttaatcaagtctggcattgggcaggactgctacaggtggtaacagcaatcatggtacttctccttgagcatacttcctgagcctcctttctctactgaactcttccaagagccagtgagaaaggatttattagccctgttttacaggtgaggaaacgagttcaaagagaagaagcagcttgcccagggtggcacagagcaagtggcagtgctaagactggtactcaggccttttcagtcctagtcctcattgctttacactgtgctaagctgtcaacacagcagatcatataacaacttagaggaacagcatccattgtttcattttatcttcccactggctctgaaagcaaacaaggtgggtattattgtccccattttacacatgagcaaactgacactgagagatcagaagtaccttggttcaagtgcagctgagaggggcacagagtgagatgaggtatgcacagatacacaagaaagaagcttaagaatgtctttaataaccacagctctcggatcactggattcatgaggactggaaggggaaaagaagcaaatggcaagaaaacagatctaccaaaaacaaaacaaagcaagacaaaaagcctctcacattcttacattcagccaaggattttgtaccttcttcactagtttgttcattcataaaatgggaatattgaaacactaatttctttggatttaggaagaatttttcagaattattatttttgagctcctcctttactacccttttcatttttcatctttagccaatggtccatttggatataaattaaactaatctaggactaaaaacctcacattgtaagatacggaagtcagaattattgtgcagtttggtatttcctaagtaatgaagtagttgggtcatggcgtgctttcctgattcccacaaactgacccttgtgctcgctcgtcatgtactcaggaatctttattccattttaaaggagaaaaatgtttgaatggatgctttatatattggtatttttaacacacagatgttgtaacatctttcattaatgtgtcaggagccctttggaagagactgatctagtaacatttcctcattttatagatttccttattttatattcaagttatctattgctgtttaacaaaacactccaagacttagcatcttctaataataatcatcttatatctactagttctctgggttgaatgggctcagctgggtggttcttctgcagctgtggttggaatcatctggaggcccctgtctgttgcctaagggtctctccacacagtttttccatgtgacagtgtagccagatttcttacagagtggcttggggctccccaaaaaaacataaaatgtggaaattgctcaaggtttagacccaggactgaacagtgtcatggtagccatattctggtggttaaaactagtcacagagctactcagattcagtgtgagagggaaccacataaaggcataacaccaggaggcatgactcattgggagccatctttagagaccagctcccacagcccaaaaagggcaagtgactggcctggtgtcacactgcaagttagttaccaaaacagaaaagaaccttgttttgcaaatctctaaattattgtcctgtcctcactactatatatgtgtaaaaatgacttgggggccctacaaatccctcaattagcaaaaaaaaaaaaaaaagagagagagagacattgcaggtttttccatgagtctggaaattctgttgctcagtgtactaattgggagcttttaaattataatttacagaaaccaactcaatctgactaaaagaacaaagagtattggttggctcatgtaacgagagcccagtggattgggtaagcttcaggcactgctagatccatgggttcatgcaataatattgggatctatttcttgttatcttttggctctgctctcatctgtgttggtttcattttcataaaggccttctgcacagcatgaccaatgactattttgtttctgtaacttgaaattctcaaaaaatgtagttcttttttcttgtctatgtatagcaattccctgagacccacttgctcatccctatgtgtgggtggagagtacatgtgactggtaaccccatcagtggggaaggggctcttcctcaaaggaaaagattccaggcagacagaagaagtaacaaatgtttactacacccagaggcttgtattccttgaagatttgtttccatgtggaagcagttgaaaactggtacctatgggttgcactctgagatgtgttttgtctgactcaaagaatatttttatatattcttggaacagcatttaaaaatcagaaaatagtttataaaaatctggatttatggtttctctttaaaaaaaaaaccagatctggcagttcttgaccttcctgttttccaatttccttatctgtgacatggagatattagtaatacctaactcgtgaggttactgttccatggtgagcaggtctatgcaaacctacctctgaaggctgaggagctgagaggccaaagaaagaggctgacaaatccagtcttgcagaaagaaatttcacagggacataaaaacaggagccatatctcaggtagccacaagaccgtggattcccatacctgacctccagaaagtattcttaatatatcaagcttttagcataaaacatgtgcagctgatcatgtcttcagactttcttgccaagacttgtgaccactggagaggctggataagcatctttatgaagggttatctatgctacaggcatttttaaagaacttactgtagaacaacttggtatgtggggcccaaatatccatcatcatggtggtttcacttcaagatggcctcactctggccatgcaacagggtgttttcctacagttgtgaggattacatgaaatgatgcgtttaaagtttctcacactatgcctggcacatagggatcagtcatgaaatggcagttactcttctaataatttgcctgagattatacagtcggtgtgttaacaatacctggagctgtgttgtgactttagatgaggcatgaactctccagtttggcaatccccaccattctttgttgtctcacatgcagcccgtgttcctcattgatcttaactggcagctccctgctatatagcatttcttcttagttttcgttagcactcttacctggacccttgtactagccttccaacctgggtttgctcttgctctttggtttcactgctaggaatagaaactggaaatagcatagtttcactaagtcagaaattgttgggattttcttcttagcacataaaaatatatggagattgacaatccattgttggtatggtaggcttactgccatcagggacccattcttcttctatatttccatcctactatgtcggtgtgtagcttgcatcctcatggttaccccccatcatgttccaagatggctgctgaagctccagtcatcacacctgcattccaggcaagaggtaagggagctagaaaaaagggcaaaaaagatctagccagctgtttccctcctcaccctcttcttggagagcttttttcaatgtcccaccaaaaaaactccctcttccatcttagtagccaccaatagctgtgggaaaggtgggaaatgtagtcttttagctggatgtagtcctgataccaaagaaaaaggggtgaatggacattgattgggccacattcacctcatttagcatctccatacaacagcaagagcaatattttaaaaattaaaaatagatgaccgatttgtttcctgttgggactcataaaaaatgaaaaataaaagtagatcacctcattcctggctgaagccagcaaaggcttccaaccactgagaatgacattcctcattgtcctcttgacttgcaaagccccacatgatctggcccctgcctatttctcctgcctcatcatctcccatcactctcactcactgggcttcagcctctggcctcctgtctgattacctcagtgattaaaggtcctcactttagccacatcatctctacaacttacttgttatgtgaccatgagaaagtttcttaacttctctgcactttggaggatgatatgttatagggtagctgtaacaattaaatgagaaaatacatataaagctcttaaaacagattctggcatttagtaagggccatataagtactaaccattaatatccatagttgttcaaacaccaagaactgtcctacctcagggcctctgtactttgtgttcactctgtctaggatgttcttctcccagattttcctgggactttcatgtcactcaaatctctgctcaaatttttgctcttcagagaggccttaaaatagtactactccatcaaccttaattctccttccctgcttcattttttatgacatcttcactatctgaaattatatacttatttatcatcttcctatttcttctagaactttagatcctggacaacacatctgtattccagccctaagagcacttcctggcatgttgtaaatgccagataaataaatttagatggatggatagatggatggatggatggactgatgtgtggatgagtatacaaagggatgaaatacagagatgggtggatgaatggatggatttgtagatagactgatcaacaaattgatggatggttgggtgaattaaggtatagataaatggacatgcagatggatgaatatttggatggatgaagtagatgaatggatggaggatgcatagatggatggatgggtggttgaatagatggagtggatggaagaatggatggatagttaaatggatgattgaacagatggtgtagatggatggtggttggatggatggatggatggatggatggatggatggatggatggatggttggagtggatggatagatggatagatggatcagtgaatggttgaatgggtggttgaacagatggagtagatggatggaggatgaatggatggatggttgaattgatggagtggatggatggacagatggaaggatggatggatggatggatggatggatggatggatggatggttgaattgatggagtggatggatggacggatggatggatggatggatggatggatggtttgaatggatggttgaatagatggagtagatggatggataaatgaaggtgttgacagatggagggaaggttgaatggatggatggtatgacaaggaaccattctaactctgtccctctcacttttgttttttaggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccaggtaagtggagttttcttgcaggtgactctggagacttctacccctcctagggggaagtttggggacttcccaccctgatgacctggcagggtgtcagtggggcactagaggtgggttgaccatgaagcctcagggcccctcacttacctgcagttgctcctcccagggccagtgcctaattttatgtttgtaatttgtattccttaaaagcctccccaagtcatttgagcttcaggtcccttaaagcccggatagctcacaactggaaggaatttaatgaatagcgtgaaaaccaatcatcccagttcgtccaagactgttcccatctcggcattgaaagtctcatgtctcagaaaacctctcagtcttcagcaaactgagactctactgtaattcttatagcagaatgggagtgggagtttagtatcaggagcctgacactagaaaatcccattgttgagaggctgcatgtttgacctgatggtgccaggccccaggtcccaccacagcccaggagccctcctgctctcccaccctagtgacctggcttgtcctcagcgagatctaccctgtggagatacgaggaagagccttcgccttctgcaacagcttcaactgggcggccaacctcttcatcagcctctccttcctcgatctcattggtgagtccttcccagacaagtccgttttttttctgtggcccaagctccctactctaaagcagaaatttttggattttcctatgtattagctgcagaactattattctgtgcagaaacatcatcaaatgtccaagacgacatccaggaccctcatatgcactgtaaaactccccaggccagctaatgggtgatggtctacacccagtactggtgagaggtcatctgaggtcaaccggcaggagtaagagtagcaatgtttatttgctccaaactggcttaaactggttcatgacacctgccaggtggaagtttttcttggcttttcttttctttttaatttttaattttttttgagatggaatcttgctctgtcacccaggctggagtgcagtggcacaatctcagctcactgcaacctccacctcccgggttcaaactattctcctgcctcagtctcccgagtagctgggactacaggcacccgccaccacgcccggctaatttttgtattttttgtaaagacagggtttcaccaggttggccaggctggtcttgaactcctgacctcaagtgatccacctgtaatcccaaagtgctgggattacgggcatgagccaccgtgtctggcctggaagtttttctcaaatcaagtttgggtgacatcatctcttcctccctagcattgaaacccattctgaggtgtggtgggatggggtggaaatgatgtgggcccagaacaccagggaatgactctgagatgctgagatgctcatggctccaggccctggtcttcagtgggtattgctcatctgggccagagtacacaggctccttcactgtggtccccaaggcacagttcttagggttcagttattttcctattccctatggccaagagtttccttcccaaaggtgcagccaacttgggaggctggggggcagtgctgtgggaaaccccagtggaagaaccccccctatcatggctgtcttccaaccccagtcttagggaatccaagcttctccctgcagcctcagtcttcaagcatttccctttgtgtggagtaaatgagtgagagaggagaaagaaggagagaaacaaggaagggaggaaggaagggagggagggaggaaggaaggaaggaatttattagaattgtgtcatatatcatccccatttcacagatgggaaaatacatccttaccccgtccagccagggagtcaaaagactagaaccagccccactgccttccagcccattgctctccctgctggcgataggtccagctggtcatgggaggctgcctaaaggaggtatggacgtggctgtcagaggtgagaatggcttccaaaacataatttgtcttccaccttgacaaagatccttcctccacagcctcttctctgtcttgggatgaatgacatcaaatgactcagggtcattcccatcttggctgctggttctgagacccaccggaggctctaggaggaggctgactctgggactgaactgtggcttttgtcctctctcccaaaccagtcacaggtcaaactggctgaaactcaattctctgaatgatcaattcactgaatgaccgattcatggaatttctgggtgtgttttttttttttttttttttttttgaaacagggtctcactctgtcgccctgagtgcagggtggagtgcagtggcatgatctcggctcactgcagccttgacctccggggctcaaacaatcctccagcctcagcctcccgagtagctggggctacaggtgtgtgccaccatgcccagctaatttttttattttttatttttagtagagacagggtttcaccatgttgcccaggctggtcttgaactcctgagctcaagtgatcctcccactttggcctcccaaagtgctgagattacaggcatgaaccactgcaccaagcccaattcatgaaatttctaaggattttttttttttcaaactgagatttgccaaggccgtgtccatgcagctgtttggccactcagctggatccacgatccctcaggccaggctttcggagcccaagcgtgctccacgggatagtgctctagatgtgggtgaggggcctttcccataaacacaagttgcctttgtctctgtgcttgtggacttgcgtcctggctcatccccgcctttgagacaatcagcgagatttccgctttaaggtacttcactgacagcttattggtcactctgcaaattgaccaacgggaacatttgctttgagtgaactgactttccatgcctgacctagaacctaccagttggcccaggctgcggggccagagtgcttggtcctgggcctacactcccgccctcctgtttccaggcaccatcggcttgtcctggaccttcctgctctacggactgaccgctgtcctcggcctgggcttcatctatttatttgttcctgaaacaaaaggccagtcgttggcagagatagaccagcagttccagaagagacggtaggaagctgacagggtgggtctgggggaagagctgtagcacaccccaagcacacagcttcaggattttagtctttgtgctttccttttgcaagcgggcattcctcctgtcttccttattgcctgggcactatgagttttttttttttttttttttttttttttttttttgagatggagtctcgctctgttgcccaggctggagtgcagtggcgccatctcggctcactgcaagctccgcctcccgggttcacgccattctcctgcctcagcctctccgagtagctgggactacaggcgcccgccaccacgcccggctaattttttgtatttttagtagagacggggtttcaccgtggtctcgatctcctgacctcgtgatccgcccgcctcggcctcccaaagtgctgagattacaagcgtgagccaccgcgcccggccggcactatgagttttgtccggtcacacacaaactgttttccttgagttgttttgtgtctccctacagtgccttttcatttgactttaagacccagctcatggggatttaaaaatcatttgattatggaatcacaggaggctagaagagtagaatcttaaaaccataaactatcttagagtcacaggaccttggagtagcaaaatatcataactatggcctttaaacattgcacgcaaaacgcttgtgggcttcatgcattcattccgtggctatttattaagtccttactctgtgccagacagtgttcagagccttaggaaacatgctgagattaaggaagacaaagtgcctgtcctcaagagcttccatttgatgggggagggaagccaacaaatgcataaacaagagcgttttagttggtgatgagtaattaggagaaaatgaagcagagcaaaatatgttgagagggccaggttgacacaggaggaacaaagaagaaaggggttgtggctgaagtagagtgggtggtgagggagggaagtcgtctcagaggaggtggaatttaagttagtgagaaggaggcacccacgtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgtggagggtcagacaggccagatgggtaggatcacatcaggtcttcaggttattgaggggagttcagaatcttagcatcatgagaccttaggctgttcaaataaaagaagagtgaaatgggagcttcagaaggaacttcaaagtgctacagtcctaagcatccttggcaaatatccccagttacctcttaaaagcaggtgatagtcaccagctcctgactgcccattctgtttctgggaagtcataaaacgttttaaaaaatcattctattattgactagcatccctgcactggctgctaagccccaccccaatctggatcctaatgtaagaacctgtgacccagtcctccccaccccagaatgttctctcctactttgttgagtggaaccttctgcagtttcggcaggcgcctcagcaacccagctgtattagttaggaaatcgatttggctgcttgaagtcgtccaaatgtcggttgggggtccagggttgggtggatgcagcatgccatgagctcatgtagggtcccaggctccttctgtcttgttgctctgccacctcttccatatcacctttcctgcatggcctaaggaggtgcacccccacatacctgccagaggatgggggaggggaaggggtgggcacagtcctcaaggtcacttccacccacatgactttccatagaacttggctacacctatatgcaggggaggccaagaaatgtggtcttcaatctgggcagccatgtgcccagctaaaaatcgagggttctgttactagacagctgcctggcatctctgccacactggttttcttgggagaagattccaaatccatcctctgggataaaaagcaacggaggcagaaacgctggtgggagccagctttggggtaaggcaggatgtgactgcagctgcggggtgtcagcctggacctggggttacatggggggagccaaggccagcccttggggactggaggctgggtctgctatgactctggagaagacaggaagttaggggtttttgtggagtccagaggcaggtctgtgttttatcatctctgtccctagagttcagggggctcttgatatcagaggccacagagagagagagaaactcgactttaggaacacagggaccagggcatgtccagggattttgacagcaggaactaatgggatagtcttttcagcagcaactattttcactcctgtgtcctccatacaagagccatggtcccaggagaaagtctgattggccaaggctggtttatgtgcccacctcctaacccctaacttagccaggatagggcagagatccttgattgacagtccagtcaagccacatgccacgttccccaaaaatgggaggcagatgccggtagagccgtcacccactgctgtagggctgacttattctgcatccctgtgcctcagatgtgcttgttggaaatggggacctacatcttatggatccagctcctctacctgctttaaggacacattagtaatacaaggggctcaaatcgtcttacatcaatcaatggcaattggttgccgaaatgttgtttattttgccttcttatcaggttatttctgctcaaaagagacctttaccaatccctcaggggatataacaaaaaaaattcaaaaattcctgttttatcccagtttctcaggaatcgattcattcaactttcagcaaatattttcaagtgccgggcactgtagtaggctctggggacagacccatgaccgggagagaccctgtctctggacttagaaggaagttacattttaatgtataggagagagatagactacaaaactcaaaaatgcacaaataagataattcagagtttttatatcatgaagaaaataaggcaggttaacctaccagggggtgaacagcagatttgggaaatggatagtttctttagctagggtgcaaacagctatgggtgcatttgtgttacaagtgtatcaggaattttcaacaagcacggtgatatttttgtgtatcggtttcactcactgccctgtttccagggcctagaacagtgcctggcactgtcatctttaatcatatctctggctgaatgaatgatgctcaaggaaggctgctctgagctgagactggaattacaagaaaaagtcaatggtttctagagctggaagaaatgttcaagcagaagaaacagtttcaagagctggaagaaatgttctaggtggagggaacagcaagagcaaaggcccggaggtggaaacaagttaggagttttgaagggagagacaggaggcctatgtggccaaggcgtgatgagcaaatgggactggaggggttggtgtgggggagggcagccatggtgagaagatgggatgttaggctgagcatgatgatggtctccttctgagcagatgtattagtccattctcacattgctatgaagaaatactgggtaatttataaagaaaagaggtttaattggctcacagttctgcactctgtacaggaagaatgatgctgttgtctgcttagcttccagggaggcctcaggaaacttacgatcatggcggaaggcgaagggcagccagcacatcttccatggcgggagcagggggtggtgctgcacacttttaaatcaccagatttcatgagaacgaactcaccatctcaaggacactaccaaaagggatggtgttaaaccattcatgagaagctgcccccatgatccaatcacctcccatcaggccccacctccaacacggaattacaattgaacatgagattttggtggggacacagatccaaaccatatcagtggagagtgacagatttttgcgtttaggaaggtcattgtagatgcaatggtgacaaggggctataggaggccagggaagacccagggagaccagggaggagctgctagggggtccaggtgagagaaggtggacatttgtaataaggcaggaggcaggaagggtcatggtaggagtgaaggtgggattgggtggtgggaaccccagtggaaggtccactccccagggacggccccaggccctgccaccccctgatcccacgcattctttgtctgacaggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaattgtgtgcaacaaacatatcttttatcatagtaaaatttacacacacacacacttttcttccctggagagctgttgttaaacatttaccagcacactactgcttagagctgtgcttgtggccccttcagatctcttctctctccagggacccataaacctcactcaattctcctttcctctcctatcagcctggaagaatgctctcctagtcctagggtgaattctccactttcttgctccaggttataaacttggggttcaggtagggaatataaatgagtgaagccatttaagacattagggagtagtggggtctgtggaaatggggaaacacagggtctgtctataagggtgactgaccctcaattccaactggtggctgccatgtgaccctcaattccaactggtggctgccatgtaggaatgtgggcccaatgtggcatggccgtctgtgttttcaacaaattccagaaattcacactttggtgcaaattttattgatttttaagttttggcagttgattccaaacttaaaaatagcttggaagttaaacaaaatactccgtggctagatcacagacctcagtctgtgcctctaatctctatgtttttccctctgagacattcctttcttctgcatatttgaggcacttggcttaatctccttaaagaatcatggcttttgggccgggcttggtagcctacacctataatcccagtgctttgggaggccgaggcaggtggatcactttaggccaggagttcgaaacaagcctggtcaacatggtgaagtcctgtctctactaaaaataaaaagattagctgggtatgatgacactcacctgtagtcccggccacttgggaggctgaggcagagaattgcttgaacccaggaggcagaggtcacagtgacccgagattgtgccaccgcactccagccagagtgacagagcgagactctgtctcaaaaaaaaaaagaatcacagtttttgaaaaataaaatgccaagcaaactgaatacccaagcacttgaattgggtgagtgaaggggctattactgaacctgaagtataagacacctggagggaatgaaaatagtccacacctcaagcatcttatactggcacaattaggtgcgtgacttggggagttgttcatctctattatggggatgacactacttaactcttcagaaatgacacatgtcagtcacttagtgcagggttcatagtgggtgctcctaaatggctaactgtcccaacagcctccagggccatctggctttaggtaaggataatgaggccaaagaccaggtggtagtctggaaggggagaagggggcattaaagaaagctaaaaatttgggggacaccaactaggtgctcagttaggagggttttttgtttgtttgtttgtttttgacagggcttgctctgttgcccaggttggagtacagtggtgtgatcttggctcacagcaacctgaaactctggagctcaagcgaacctctcacctcatcctcccaagtagctgggactacaggcatgcaccacaaagcctggctaatttttaaattttttgtagaaatggagtctccccatgtttctcaggctggtctcgaattcctgggctcaagcagttctcccacttcggcctccgaaagtgctgggattactggcatgagccaccacacctggccaatgctcaaagatctttagcaccaaccagaggagagagacagtctgttcattggtctgcagggagagcactgggaaattcttctccttcccgcaagtaactccagaatcgcttcagggaagcagttcccaaacctcagtcttgtgcacagtcctttaataaaatatgcccatcacttagcacctttggttatttgccagattgtactacacagacttcttgctgaatgcttttcttcacatttatttgctattccacttaaataaatgtattttaaaaggaaactatgttaacctatttttccttcaaatgcatatttattgagtgtcttatatatgccagtcactgttctagaccctggggtcacagcagtgaacacgacaaggtccctgtcctcatggagctctagtaaaggagataaattctaaacaagagatggggaggaagggagggaggaaaggaaaaaggaaggaagaaaagaaaaaatgaatgaaacaaggaaggaaggagagaaggagggaaaagcaagtaggtagagagaagttaattagtgtgagtgctaacaaaagttacaaagctaaagagaaattgggtgaggttcagatgcagatgctttcatgccatgttagctagagtcgctagggcagtcaggaagagcctctttgaggtgctggcatctgagcagagacctgcatgaagggttagagtgagccatgggatgattgggtgaaagcatcccaggcagatggcacggcacagcacgtgcagaggccccaaggtgagactaagtttggcatatcagaggaacattaagggggtgtgagcaaagggtagaatgatggaagaagaggaggctgagcttagcacgggtctgactatgaagggtcttccagaccatggaaatccctcagattttattccagatgtgttgggaagccctgaaggggtgtgagcagtggactgacatgatctgacttgatgctataaaatagtcattggatgttggtgaacacacaaagtgaatatcaactgcagaaataggaagaaaacaataaaatactatgaaagcaacagattcagtaaaccctcaccagccattgttatctactgaagattctgaacctaaggtctgctctgtaatgaaaaggggagcttagcgggtgtgagagaggtgttcaggacatagtagcaacaactgaagactttctctttgtctggattgaaagaacaacaatgcaattcatcatatttatatggtgtttgtgaaccacctaaaatcatttccagtgctactggtattatgcttctgactctggtaaatacagctttaaggtgagaataccaaggaagtcacaagcaccgagagaaagttgacctcttgttactttctcatgtcagaccctcctagaaagaagcattgaccttcagcatggaactagtttagagtagagtgaagtccctgcagccaatgtccttccaggaagaagtaaataacatcctcatgggttacccttcaccggtctggcctctcccagttcctggactgtgaaatcctagaagcctatgtttcattttacttcatacaccctgatgagctcagcctcaaacaccactctttcaaggctgtatttcaaacatcctatttcctggtcaccgcatccttacatttctgctaataccttaatactgtctcataaccacaattctctgatctcatgaagacctctgacctctaaatgctaacccctgacctcacccctttcccagaatctatgaacctcttcctgccttcactttccttcttgtccatccaagatcccatagcccaaccttataatccatcctttgcaaacacccccttgtgcacttggtaatgctaatctcagatcaatttacacacccatcttctctgcttgcacgtgggctgtgaatgttgcaggagagaagtcacacaacctgacaaacaggtttcacttaaagtccatgagctcaaacctcagactcaccctccaaaccctctcatggcacacattcctgctccacaattcagcgatttgatatggtctccttgactgaaactgtcctgtctctttcatctccctcactctcagctgctaaccctgcctcatacttcattgaatgaacagaagttctcaggagaggtatgttccctgatatcttcatctcttttaggcatagtaacagagcctctgatgtttcgctgggaacatggctgcccagaccaaacaccgcatttcccaggctcctttgcagccaggtggggccatgtgaccaagttcagtctgatgtgagggaacacaagtgatgtgctccaggcaagccctatggcagagaagactagctgtccttggaaatttattctcccttgtttctttttaataatagaaatccctttgttttagctggatacatggccatctagctaaagatgacttttcccagcgtcccttgcagcaagagggccatgtgactaagttctggccaatgggatgtgagcagtagcaatgtggcatcttctgggtcatttccttaaagggaagatgtttgcatgaaatcaacatgcattttcccctttctgcaggccagggtgggtatatggtggtcagctttcaccatgaagacaaagacaaggggacggtggaacaagatggaaggtggctggatccatggataccttcatgaactaatgtatctagtggccctgtttcaacaccttctactggactgttatatgaaagaggaatcaactaccttattccagccaacttatgttagggtcccttttgttacagcgccttagcctgagactttactaatgcatagcctcagatggaatggaagtgtcctttcctttttccatcttctgttcttgttgactgaaatagaggtgtgttaggaaatcatctggggtcatgcagacaaggacaacatcctagggatggcagggcatcaagctataagaagcctggatccctgctgacatcacagagcagggctgccacattagccgggactattacgtgaaagagaaataccttctatctcgtttaagccactgctattttatgtgtctgttacttgcaaccaaacagcctgaccaatacagggggccactatcaaaattacagacctgtccattttctctgctctatcctgcatccttctaccgtgggaccatcctcttacctggactgctggggagataccatcctcacattacaccttggtgagcttctctgtctcctgaatcaccaacctcactttccgttggaccattccaagtcccttgttaatttcctccatgatacttattttgccttctaattattttgattgtctgtgtactagaattcaaattaaaattcttccacctctcctttccatcctttttctccatccaatcctcctttccaaaaatagtttgattgggaatgaggatttgagccagtaattctcatttatttgctccaacaaattcaacctctacctgctctgtgtcagcaggttgacttgtttgggctccatcaatgggctgccccatgctcagcttctggttgggttaggagtcctggcatttggtagcagggagggggaagaatgagtagagacgggttttcatcaggctcacgcctgtaatcccagcactttgggagccgaggcaggcagatcacttgaggtcaggagttcgagactagcctggccaacatgatgaaaacctgtctctattaaaaatataaaaattagccgggtatagtggcacacacctgtaatcccagctactcaggaggctgaggcaggagaatcacttgcacccaggaggtggagattggagtgagccaagatcatgccactgcactgcagcctggacgacagagcgagactccatcacaaatcaatcaatcaatcaatcaagtgaacatgcctaaagaaaagattaaattacctttttattgtcactgtagaaaagaatcttatgaaactgttatgagagaatctgcagccaaaaatggagtaaaacaggtgtaatagaggtgggtcaggccggtgatgatgatggtgatgatggtgatgatggtgatgatgaggatgaggatgatttatcacttattttgattttcaggtgcttgtggcatttgccacctttttaacatttccaacttaccatgattccttttatcactttaaataaatattcatgtccatacttaattttatatgtgtagtttgttttttcttaaaagaagtccttaacattaaatcagcctggatgagccccttgctggccagagaggtgctaggacagaggatgggaggtcagctgcaaactgagtgtcctcctgtccctggaggctcagcctgagttctcccccttgtcctctcttcctccctccactggccacttcaggatccagctggaagagccaaatcttggcgctcagaaggggttagtcacagggcaggctttgttgaaagcacctgtggcctcctaccttgggcaggagatttcctccaaaaccgcatcagggggaaatgtcagggcacctgaatcgatttttctgcgtaggagtgatttttattttttcctacatctcaatcgcttctaggattcaggatcaactaggattaactggaaagccctgaatatgtgtttgtaatggcaccttctcaattatctgccctctttaggagtggaatgtagggaatgccagaagcattcgaaatacatgtctaggttcattaatttatatggttaaaaggcatgggtgaagaaaaaaaagaccatcaaggctgtttggaccacacactcatccaatacttgactccctgcattacttagaaaacttttcgacagaaacggaaaccaagcagacttaagttacccgggaacccatttgttctggactaaaaacgtcatagttagtcctggtttcagacaggctcagcttgatccaggactaggatgatgatatttccttttgcctctgttctcagtcttttcctatcacaaaatctctcttcttccagcagcaactctggctatgcccttccaggttcacatagaggaggagagagggtttccttctcccccaagccccaccacatagttctagcatcccactggctctctgtgggttaaatgtgcctctccagacccactcatggggagcagggcgctgggagatgcagacgggcttaactcgagctgctggaggtggggcttgtgttggcttcctaggcctgcattcacatagcaacacacactgggtggcttaacacaaccgaagtttattctcacactgttctggacctgagaaatctgaaatcaaggtgtcagcagctccctctgaagactccagggaagaatccttcctcgcctcatccagtttctagtggttgcctgcagttcttggtattccctggctggcagctgcctcagtccaaatctctgcctccaccctcatgtggccttcctcccgccgtgtgtctcctctgtgtctctgtgttacatttccctcttcttataaagacccaagtcattggatggagggcccacccgaatccagtgtgacttgattacatctgccaaaatcttatttccaaataaagtcacattcacaggggccaggtagacatgaagtttatgacactgttcaacccagtacaggggccaatcaccccagaccctatggctgagtggggaagaagtggacaccataaggcaagttggcaagagaagaggaaagagatgctggaaatcactctgcacatttcccgtggccacactgcatcctgtgtccagctccgcttgcacacccccccagatgggggagtcactagtcactaccgagccagacaggctgtcactccggctggtgccctgcagtgtggccctgccctcgtgttcaccaggggttttatttgtggtcttggtcatgacctgatcgaggatcatggggttctcgggcacaaaactgaactgcgagaggagctacaggagggagggatgggggtgcagacggagcgcgtagagagggggtggcctggccaagaggaagggttcagaaggtgcagtcaggagacctgggtttgattctgctgcagctacttagctagttttgtgaactctggcaggggatttaacctctctgagcctcagtttccttaactgtaagatgtgggcagcagcagcccccaccccaaagggctgccgggcagattcactgagatactgggtaggaaagctctttcccagctgcgaagggcaatgcaaccacagggcggggatccaccaacacctttcccccagaagcagggcttcctaccccacccagggctgtccctagctcccgctgtcccagggccagactcagtttccatatttgttcattttactttccagtgtaaatattttttccatctgtggcagaggaggaggaggatggcattttgacgtgagacacaacattttcagacaccctctgaaagcatttccagaccctcacatgctgggtctcatccaaggatagaaaatgatttatcgtggatgctttggcacgtgcttttggagtttttcctcctaatgaaatgtttaactggaaaagctgacattctgcttttaattgattctcatgagatgagaaacattcccaggtaggttatattaggttgaaagtctcctattctaaatgaaattaaataacaaataaaattcagttcttaaaaatgattctgtttaacattttgaagggtggcacaccaaaacattattgcccatttccacattatagtaaactctaatttatttagttttgctttgtattaaaattgtattaaaatcaaaacgtttgttgacccaatttaggtcttccaagattatctagttaacatactctcttaatagtcacatgaattctcttttgttgaaatatttgcatttttagcaactgtttttgcatattaaatcacggctttcatagtgtgtgtgtgtgtgtgtttccactgaatttggtgcacaatgaagttgctaaattcttccagatttgggactgatgccatcctgcctctcctggtttgacaggttgggttgttggttaccgagatatgatccccaaagcttcctcttcagcaaaataaatattacatggatccttaagctgatcaatagaatttcaatatctaaagcaataaagagattaaaaaaataaaacctccaagttacctcttgacggtgaataacatgctttgtttgttttttgattagattgatagaagcccacatgactatagaatctctgatgtcacatagtgttaggcgcgccagaagtaactataaagtgagtatttctctttttgacttttcaaaagccaaagctagacctaatgccaaacagtgattattgtctggatactattgttataggaccaacagattcgtatacccactgtgcagtaacagacccattacaccgaaacagcagagatgaagcagggaaagagtttaatgatcacagagacatctagagcccaggtcctagaatgaaaaacctggaatagatctgaaccctaccagtagcctgaaccagggctgctccagccaactcacatctcagaaagcgagaaagaaacactaattaagagcctgggaggccaggtgcagtggctcatgcctgtaatctcagtttgggaggccgaggtggacagatcacttggggccaggagttcaagaccagcctggacaacaagatgaaacaccatcttaactaaaaatacaaaaattagtggggtgtgatggcacacgcctgtagtcccatgtacttggaaggctgaggcatgagaatctcttgaacctgggaggcggaggttacagtgagtccagatcacgccactgcactctagcctgagcaacagagtaagactctgtctcaaaaaaaaagaaaaaaaagagcctggggttgtttgtcatgcagcagatgctgactaatacagaatccaacaaggtagagagtgtttttacctggtccattgagtatagccttgtcatgcctgaaagccccaaattttaaaaaataataatagtaatccagtttttatattcaaaaatgaaaaatattgaaaaacataaagaaagataacatcacctatgacctaccacacagacataattgttaacaatatttttgtatatacccgtgtaatctcttttctctgatgacagatcaagttacctacataggaagatagtgaaaaggcaatcctatccttccaattgttcagatcaaaaactttggagggccagacacagtggctcacacctgtaatctcagcactttgagaagccaaggtgggaggattgcctaaggccagaagtttgagaccagcctggagaacatagtgagactctgtctctatcaaaaaaaaaaaaaattagccaggcatgattaattagatcacaggtgcacacctgtgatcctagctacttggaaggctgaggcaggattgcttgagcccaggagtctgaggcaggattgcttgagcccaggagtctgaggcagcagcgagctgtgattgtaccactgcattgcagcctggatgacagagagagaccctgtctttaaaaaataagcaaaactataaaccaacaaaaacaaacctcgcagtcacccctaactcctcttttgcactcccacatccaatctgttagcaaatcctgcaggctctgcagaatttgacctttctcatcatctcctccatcaccatcatcaccatcactccctagattgaggatgccactactttctaacaggtctcgttactttgctccttgccccctatctatcttccatgcagcagccataaggggcttttaaaacccaagtcagttcatgtgactcttctgagatggtctccccacggctccccctcttactcagagggttccttatcagaaactctcaggcccccaaagaacagcccagccttttcctccaatctcatcttttcccattatcctccttgctcagttagcctatcttttcccagtccctccaacacaccagccacgccctgcctggcgtccttagctctttctgtgtcgttggttaggaatgtgcccacgcctcatacttgtatggctcactctcttccatcaagagttattcaagagttatctgctctggaaggcttttcctggctaccccagctaaaatgtcacactcacatgagctcatacacatgcacacacttaatatgtacacacacacccctgcaaatgcatgcatgcacacacacatactgcacatttctttcttgctttattgcttctccttgaccctttaccaccatctaacatatgatacagctatgttgcttgttcatttaatatctatatcccttgctacaatattccttccccaagggcaggacgttttgcctgttttgtttactgctgtactcccggtgtctagaaaagtgcttggcacataagtagacaattaatatttgttgaataaatgaatgaatgagtgaatgtaaagtgcctggaacgctgcaaacatacaataataataaagcataatcattagcaccaaacaggtaaaagaaggattttcttcctttttcattgtagatgctgtaaaaagttgatagaattgaaaaatggagtttaaatatattacataaagtcattaaggccactggtaggagaattagtaataatctaactaataaaagcaaggagctgaaaggaataaggggcagtggagggaatgtatatgaacaaaattcctcatctcatccctggaaattgatcattaatacaacactctacatctatttcttaaagcagaggcctcaattctttggatgctggccctcaggtgtttttatttgttccagacattacttttaaaactttttagttagttgccaacctttgaaattcggaatatttcgcagataacttggtatttctggcttctcttgaaaatgatctggttatgattgtaccactgcattccagcctgggtgacagggcctgcattctgcaatagagccaccagatggcacagagtcacagccactccctttccatgccgcttgaactctcctgtttgctacacattaccagggcttttcactcctgatataaatgtttcatagaaacagtctctgggccgggcgtggtggctcacgcctgtaatcctaacactttgggaggccaaggcgggtggatcacctgaggtcaggagttcgagaccagcctggccaaagtggtgaaaccccgtctctactaaaaacacaaaaattagcagggtgtggtggtgggcgcctgtaatctcagctactcgcgaggctgaggtaggagaatcccttgaactcgggaggtggaggttgaagtgagccaagatcgcgccattgcactccagcctaggtgatagagtgagactctgtctcaaaaaaaaaaaaagaaaaagaaaaaaaagaaaaagaaagaaaaaaaggaaaagaaaacagcctgaaaaatagaaagcaagatttctgacagtggcaatctcaaggcagttggaagaacaggaaagactagctccccacttagaacattctatactgtctatgtgtttctgtgaattctcattcatgtcttgcttctataatgaaagggctatgacagtgaaagaaaaaaataaaaataatttttagtactttagaaaatactgaaaactataaagattaaaaataaaaactgcccatgtcctaccagttactaacaacattttggtatatattcattcacctactcttttgtctatgacaataaatcaagctagttagaaacgaggacaggtattgggatatatagacattctcacatcattgagaccacacagtatacgacacgctgtggcatttactttttgagattatcaagcatttcacatgaggctgagttcacaaatatattgtctttgccaaagttacaaacagtatccacgatttcccccagggtctggctttttgggtctggctttttctttacttctgaacatgtagaaaaatgaattatgtgcctaccaagacaacattgcagttttcctggcaaaggctaattctgccgatggaaacagtgttttcattttctttctttctttctccccaccattctatgcttttctggtttctctgtgtgcgtattttccccctggatttgacattataaagttgctaagttcttccagatttaaggtgctatgccatcttaaatctctggatttgacaggctgggccagtggttactgagatatgatccaagaagctttctctggggccatctgtcaatcagatgtcagctcataaggaggaagaacttggctgctggcctgcacttggatgccagagttggttgccttttgcttgaattgtgtctgcacagtgctaggcgcccagtaaattctcattgtatccctgatgggtgaaacctcatcaggtagctcttgaatggagatataaaatgtttgcctcatgtcaactcttcttgatctttttgacccatgtcttccgatctgaacagcatttaaaactttctcccattgtagcacctatggccatactaacttgtctgatcctattgtgggtgaatttttgaagacaattataaaccagcccacatgtcagtacctgagatttctagccttccagtgtcatccattctaaaacccgatttgaagatgcaatgtaggaaaccaagaactaccaccaccacaccctgtcatcgctgtacctttgaggtcatttactcagctttcatgtctggtatgttgaaagagtggaagttgggagttagaggggtgcaagtagcaacttgattttccctctcactgcccattcaaacacaactggtgggatagttctttactttccccgaatgatccattgggccgatcctttagcccttctcctcacccttagatcatgaccaataacaatatggtgatgattataaaaataaaatgtctccaagtcacttctgagtgtagcaacagtctaaatgaagtcattagaatgtcgagtcatgtcaaaactccaaacttcattcatattaaacctctttcctcctccactctcatttcttctcctccccagcccccttgggctctgaagaggtgaggagcagggatgttttacttggctggtgttgtgatgatgtgatcttgtgctttctggacttagagggccaattccttctttccttagcttgtgtgtcccaggggagggatggcggttcttggcaattctcccactggcaacctccaaatttgcttcctgggaggcaggcaatgtgtctcctctggcaggccactcttgagtgtgcctgcaggtcctgggcatcctgtggtccagcagccccatttgggcgcctcacattttcaggcagtcctgcactgggaatcccaaataaccccaggccagctgcctctggaggttcagaacctgctggaagaaacttacacctttggccttctctaaagtcatcattcctgatgcagtaatccattttcctgcagaggctgagcggccatggtccctaacttctacccatttccaggcatgggtttggcactagtctgtccagaagacacagggcaagctctttcggtggtttccccacatctctctgactcggcgttcggtgaagagttggaacggctttttctccagcataacgttggaggtgctaatggcaaggaaatgccacaggacgccaagtatcaatagtttctccaaagacgtgtctccaaacctgtattagtcccttcgttctcgcactgctaaaaaaaatacctgagactgggtaatttacaaagaaaagaggtttaactggcccacagttctgcaggctatacaggaagcatggctgaggaggcctcaggaaacttacactcacggagcaaggcaaagggaaagaaggaatgtgttcacatggctggggcaggaggaagagagagaggtgggaggcactacacacttcttttttttttttttttttttttttttgagatggagtcttgctctgtcgccaggctggagtgcagtggcacgatctcggctcactgcaacctccgcctcccaggttcaagctattctcctgcctcagcctcccaagcagctgagactacaggcacacgccaccacgcccagctaatttttatatttttagtagagacggggtttcaccatgttggccaggatggtctctatctcctgatctcatgatctgcccgccttggcctcccaaagtgctgggattacaggcgtgagccaccgcacccggccagcactacacacttctaagcaatcagatctgatgagaactcactcactatcacgagaacagcaaggggaaattcgcccccatgatccaatcacctcccaccagtccctcctccaacactggggattaccatttgacatgagatttgggtggggacacaaatccaaaccatatcaaaaccagtcctctctttcagcttctccaacctccttgagcactggggtaaggatcacaaaccaatttttttaccattgctttttgcaattcctgcagaggtggagggaagggtgcttgctacccactgggttactcctggcgtttggagcttcagccaaacggaagacagaaagagtcccatccacacgccacggctctcatttatcccttcaacaggcgcctggatcctccggttccacttctcagggtgttctgccttgcagctctggcagctgttgtctccagcctgcatcaactcaaatatggaaaacatccacgttttcttttcattttcttgccgctttctaacagtatcactcatacatttcagagagtcccatagactttccgtaaggggtggagtcacagaagcgggcatctgttgcttggacgccatccacttccattcgcctctaagctgatagctcttacggatctgctcctcagggaccccacccatctcctagttaaccaataagagcaccccacccccaccatcccagcaacaatgattggttcaggaatgagggcgtggccaaagctaagccaaccaaagccagtgatactggattctgggactaatttttaaatttcttaagaaaaactcttcgtactggattgctgagagaatgggatgtaaggtctgaactcatgtctgccttcatgctaccagcaaagagaaccttgaaaccaagtgccctgtatccagtaggtgcttaatagtagtttatcgagtgaaggaaataatggggaaaacatctgccaatgcaagtagtgccagtgcaatgattcaaagtggtactaagtgccccctggagagggctgcatacacatgcaattccaagtctaagaatgtatctcacagatacatttgcacatggacccatatcagtgttacggtgaaaggttggacaggttatgcactgcccaacattagtgtgcaccattcacatcaggcgggacagagtgggagaagataactttgctgtaaacctttgtgccctgtgtgattttttttttaccatgatcatatatagtttcttcagaagaaaaatttttatatcaaagccgaaactgtgcatttacatttctttatacattgcttggcacatcagtgctcaatatgtatcagctgtatcagcagccatcattattgttattttttaagctgttttgaaaaccttacggtgttattacaccatggagacacacgagggcgcgccaggcatctatttaaaaagtgttttcatagcagttcgtggaggctgtaattttgagtgtgtacaggagatgggggaaaaagtcttgggggtcccgtgtgggtgacaagggcaagtcttagttccaacttggtccagtctgccagccttgtcaatgaaataccaggactcccttcctgagtgctccatagtggaatcagggtgagcgtccactctttgcaagtccttagaggagagagctggctgagccggaggactggcccggggagcccctgctgcacccggacctgtgttctcatctgtgcagcagaaacaatcaaacccacctgcagggctatcgtgagattaagcagggtctctcagagatcaaaagaagcccgaactactttctagagtgaagaactggaaagaagagagagagagaaggaaaagaaagcctcaaacaatcaccaagattgaagtcactctcacaaggttaaattttacaactcacccctctgcctcatatacacggcaacctaacagtgccaggcagagatggtgggatttattttaaaacagtaacttatatggtctgatagaaggacccaagcttggccgggcgcggtggctcacgcctgtattcccagcactttgggaggctgaggcgggtggatcacgaggtcaggagtttgagaccagcctggccaacatggtgaaaccccgtctctactaaaaatacacaaattagccgggcgtggcggcgcgcgcctgtaatcccagctactcaggaggctgaggcaggagaattgcttgaaccctggaggcggaagctgcagtgagcggagatagcaccactgcactccagcctgggtgacagagcgagactccgtgtcaaaaaaaaaaaaaaaaagaaaagaaaaagaaggacccaagcttaataatttctttctgaccccttctgctatcagttctggcggtgcttctccgtgatttgggtataagcttattcgataaggttatacatatactcataagataatacacaaaagcatatgcagagggctgcggcagacagattgctggtctactggaaagccagctccccttcttggctaagagagtgcccaatgtgttccatgcacggcggatgacaatgtgcccaatggagagatgcttcagccccagccccagggcatccattgcgattgggctaagtcattcctttccgccagcaattgctttataggcaggcagatgccctggttctggccacagagacacaagtggatgtctcctgggagcttctgaaacagagtttttgtgtgtgtgtgataagatagagacacttgagaaacttctctcctgttggtcttatctttggatgttgtcagaacgtttggagctgcagcagccatcttgtgaccacaagggaaagaccaagggaattgtagagacccccatctttgtgtctgacataatcgagttgccaaattaaccagctcaattggtggttaattccattaatcctggaattatcaaattcaagatttctttttctttactttctttttttttttttttttgagatggagtcttgctctgtcacccaggctggagtgcagtggtgtaatctcggctcactgcagcctctgcctccctggcccaagcgattctcctgcctcagcctccttagtagctgggattacaggcgcccaccaccacgcccagttaatttttgtatttttagtagagacggggtttcaccaggttggccaggctggtctcgaactcctgacctccagggattcacttgcctcagcctcccaaagtgctggttttacaagtgtgagctacggcgcccagcccaaattcaggacttctgattatatgacatactttctaggaaacttgcagtttcacctcttttagatgacagattacttgcagtcaaagcccatgcaaacaacacaggcacatgtcaaatgcccccttgggtggaacgcaggaatttgcatttctaacaagctcagggggccacagtttgagtatcattgagcccagccatttcttggtctagagtaggagcctgcagaagggacagagctcaggggttaggcagacctgtttccagtttcatctgcatcccacactggctgggtgactttgcacgagggagtcaatctctttgggcctgagctgcttcattgctaaattgaggataataaaagaactcctggttttctcctcaaatctgtttctccagccacttttcccatctttgtacatgacagctccattcttccagaagttgagccccaaatactggagttaccctcgagaactctcgttcacacaagccttaccttcaattggtctgaaaaacctgtgggttctaccttcaattgtatgcacagcgagaccacttctcatcacctccatcactaccacactggtccaggcctgcattgcttcccgcctgggccgtggcagctgcctccttgctggtccctgactccacctcacccctgacagtctgtgcctcacacacagcaccagatcaattgctaaaataagtaagtacatcactgccttcctctgctcggctcccagagctctcacctcactcactcagagcaagaactgaaactctaccatggccttcaaagctcttggagatctggcttcctggtaccttctgccccatttcagctccccgcactccccactgtgctccagctgccgtggcctccttgctgttccttaaacacaccaagcaagctccttccttctgcctggaaccatcttctccaggtatccacatggctccttcttttgcttccttctgacctctgctcaaatgtcacctcctcagtgaggcccatcctgattgctcacctagatttccaccccacccaacttcttctgtcccttttttttctccatatcccacctcactaagtgtatatttgtttgcctatttgtttatttcctctccatgtattggaacgtaatttccacaaaagcaaggttcatatctgtttttctttttttaaatttatgtttaatttacatacggtaacattcactttttggagtacagttctgtgagctttgataaatgcacagtcatgcaaccatcaccaaaatcaagacacagaacagttccatcatctccaaaaatatcttcaagcaacttctggatagtgaggcccttttgccaccctgcccgatgtcaatcatggatctggtctctcctctgtagttctgccttttctatttaatatgtgtcatataaaagacacacagcttgcagcctttggggacgggcttctttcttgcagcagaatgcttctgagattcatccatgttgttgcatccatcaatcgtctgtttctttttattgctgactcgtaatttatcctatgaatgagccacttgtcaatccattccccaggcgagggacatttggattgtttctagttcttggtgattgggaataagctgctctaaccctgcatgtactagattttgcatgaacaaaggttttcatttctgtaggttacacaccaggagcgggattgcgggatcatgtaagtgtgtgtttaacgtcacgagaaactgccatgccgtttttcagagtggttgcaccattttacattaccactggtgatggaggagcctgacagctgttctgcattcccacatgttttttctcatcattgaatttccaccaccaaggatagaacctggcactggtaggtgctcaacaaatatgcacatagtaggtacacaaaaatatgcatacctactatgtgcacataaacagataactagaggctatcacacagtgggatcggaaggatgaattagggtaaaatgtatagagtgcttggtacagtgcctggcccttagtacctgaggatcattgctaacagtagaggccactctccccaggggagggccatagggcaggggcctcagctccagccacacagagagactgcctagcagaaccctccactatgctaatcgctgattccttgagctgtaggctttggggatataaagatcttctccctccaggaactgaggaggtaagaatctgcccccacgccagcaagacccgcaatgctgcaaacacttcctgaggctctctgtgcccccctccaccccagcgtagggaacccaggagacctggctccagctgtgttttccttgcctccacactcaaaaatgggaggcccacaggccaaggaatggagtaagtctgttttcctagctgaccttgtcccctcaaggggacaccagtgcccccacgctgctgagttttctcccactttagccaaactctttggctgcccttgtccacccccactgggggcctgtttgccagaatctttcagcaccttttctttttcacaatcactctgaccctttttgctattgttttttgtaggttaattgagtacgttctcctctcggtggagaccgcaggcagggccaagcacaacaggcccagcacgaagggggcctgggaggcccgtcccaactctgcagcctgaggcctgctcaggcaagggcagggggacattgatggggccaagatgtaactgacctcgcctgcaggcagcagctagctggggtggaggacgcgggggacgagagcatcaggcctccctttcaatccctgctcttccttcttcctcttttttgttttcagagcagattatccctaaattctccttcagttggtattttctgagcaccttctaaccgcagaaaactgtagcacgatgcaaagtgtaatgactgacagaaacgaggcttgcagtggtctcacctggggtgagtttgtgccccaggagacactcagcaatgtctggagaccgttttggctgtcggccctaggcaggaggggtcctgctgacatttagtgggtggaggccacggatgctgctaaactttctacaatgcacaagacaagcccacgtaacaaacatcgatccgggtgggatgtcagcagtgctgaggctgagaaaacctggctcctcactgtcccattatatggatgaggagactgaggtcctgtgcagctaagtgacatgtccaaggacacacaggatttcaacccagaggcctgactctgctgtcctcatgcacctcccactcctagagctcatcaagggacggggaaaggagttaggagggacagggacgcagggggagttgacctgggtgtgggaatggagctctgggggccttccgcagaggatgaggggactgaggggaatttggaaagactcccgggggatgggagagtctgtcatgattccctttgacatccgtttctgatacaggaaaagcctgctttgaaatttagggggtgggggggaacacctgtcacccccacacagcacttccggcagatcctgggaggggcattgcagtagcaaatgatgaacagcagagggcgcgagggttcctttgcctcctatgtaccacttttttcatcgtaaagggagtaggtgtgccttaaagaaaactgcggaaagcccaaaaaagcagaacaaagaaacctacattgcccagaatcccacctcctgggacagttgaacatttaaatagtgaatagtttcttcctttttccccagacaactttgttgacattttttattctgttttgttttgctttccaacacaggggccatcagccagtacacatgattttgcagcctggattttcacataacattctatcagaagcttttccctttgtctgacaagcccatgtcatcctcagtccctggtcaccgctgcggagtcagggcttgtgtattaggccgtttttcaatttctgtaaagaaatacctgaggctaggtaatttacagagaagagaggtttcattggctggtggttctgcagattatacaagcatggcacaggcatctgtttctggggaggcctcaggaagcttccaatcatggcggaaggcaaaggaggggcaggtgcatcacatggtgagagagggagcaaaaggggggcgtcccaggctcttaaaccaccagatgtggcatgaactgagggagaagtcgctcatcgccaagggggtggcactaaacttttcctgagggactcacccccaggatttaatcacctcccacagtgcccacctccagcacgggaatcacatttcaacatgagatttggaggggacaaacctccaaaccacatcagcacacatccattcagcagatgtgttttgagcccccatgtgtgggaagctgtgacaagcaaggagatcaactgggtgtgtgctctgtctgggggagatggaccccatccagggtcatttcagatggggcaatgcacagtgatggagtgagagatctgggctgtgtccctgggggggcctctcaaagtaggggacatttggatggggacctggatgaccaccaggaggctgcaggagctgcagggacactcctggcacgctggaagttcacatgagaaaggggaaaggcctattttggataaagatccccccaggacagggtgaggggtggaacatgggacatgaggaacatgagtggtctcagatgcctacaagtctccttcctgggcctttgggcaggtggtggcgccatatacggcagcagagaaggaaggatgacacttaagcctgctgcccctgctccccccttgatatgatttggctctgtgtctccatccaaatctcatctcgaattataatccccatgtgtcaatggagtgaggtgattggatcatggcagcggtttttcccatgctgttctcatgatagtgagtgagttctcacaagatctgatggttctataagtgtttgacagtttctccttcagagtctcgctgtttctcctgccaccatgtaaaacatgcctgcttccccttccgccatgattgtaagtctcctgagacctcctcagctatgcagaactgtgagtcaattaaacctctttctttataaattacccagtctcgggtacttctttatagcaggatgagaacagactaatacacctgcttttcccagagcctagcattcagcatgtgggaggaaggagcactttctgcttctctttcattagtgaggataaagagggacagtaccaaaggaggataaggactcaatttcattctaataaaaatgggaaccccttgcattttatttaaaatatcattgtttgtttgctctttcagattgcaaaaataattactagtcattatagaaacatgtgtaaaaatataaataagtacaaagggaatagtggttccccatgatcccattgtccagggaccctccgcaagcctttcagggtattcctttatcgtaagaccttcatcagtgtctgtgtctgcatttattcatccattcaacggaattttttgagcacccactatgtgccagtcatctttctagatgcaaaggatgtagttgggaataaaaacacaaaaatccccgtcatcatggaggtgacattccagtgagggtgacaaacaaaataatcggtaaacgctgcagtacagtctatgataagggcagaagtgccatggagaaatgaaagcagggaacccggaggagggcactaaatggggtttggattttaagcgggatgctcagggaaggtgtcactgagaggtgacatttgaacagaggcttgaatttttggagggagcgaggcatgagggcagctgcgggggaggggagagagaacagcaggtgcaaaggcccccagggggcgagcctgggtggctcaggaggtgcgagaaggtcaatcggtgagtgctgggtgagcagggatggcgaggggtggggaggataaagaggaagttggggagcagacctcacagggctgtgggggacactgagaggaccacgctttactctgagtgacatgagaagccagagcaagactttgatttctctgtaaatgttttattgtcaatccaaacaaaagtggagagaacagtaagatcaaccccacacactcaccccccagccccgtgtacggtccatctggcttcactgatttcctccccactggatggttttgaaacagatctgggcaccacctcatttcatctgtttacattttgtgaatgtcaccaaaatcaggattttcttccagcgtaacctcaataccattatcctgacttcaaacattaccagtcattccttagtgttaccagaattccagtccacgttcagatgtccctcattctctcaattcattttcgccttcatttgttcaaactaggatctaaacgaggttgtttatgacagctgagctgttccttaggtctttttaaatctatgggttcccccttcttctgtttttctccttgcagtgtgtttgttgaagaaactgggctgctcattctctaacgtttcccatattcgtagcacttatctcctttgaatatgccatataatttattcttcttattaaaaaaaaagtcctctctcccctactagaaagcagtctcccaagagcagcctgttggtctgttttgttccctgctgtgtgcccaacaccagagcctggcacagtcaatgacccataaaaggatggctaacactgaaaatactggctattgtttcccagcgttacagatgaggaaactgaggctcacagaggttaagtgaacttcaaaaggtcatacaaccaggaagtgaggagattgggatttgaactcaatctttcaggcttagtgatcaattttaacaaccatataccacactctcccgcgacccagctccctccttcccgacagatggcggctgtctgtgaaaggacccagctccaaaggcaattccccaggacgctcggggtcccactttcctaggggtgctggtgcctgctggaagctgagccccactggagagatgaggccatgctgagccaccggggacactagtcctccatgagacagtctcagcagccctgtgtgtcaaactccccagcactggcttaaactccagtggctcccgaaggcaaggacccccagccctcgctgagcatttggttcatagtaagtgaccaagaagctcctgggagacaagagacccagcaaaagtggtcaagatatctggactgcactgctgctaggcctgccaggctctgtctcctgccctccgtgtcaggccctgcctccaaccaaccagcctccaggtcagcattgctatgtgattctcagaccagcagcttccgcacacaccagcaccttgctggaaaggcaggttggaacaccccaaggatgtggtacacggaaagacagggaaccataggtgctggggtggaccctgcgatctgggctttcacaagccccagagactctatccgcagagatattctggttctcagtacctttgggcagagccttctttgagtgttgaggccagaagggccaactccttggtttattgattagtagggaccactgggctctttctcaaatgggtctaaccatttatctgggtgcaggaatgtggaatttcagtgctgggaaccatgtgcctgagcctcatgttgaggtcctctggggtcccaaggtctacctggtctagcatgcacttagagagggcccatgggtgccagacacagcaagcagcttatagcgtctgtcctcaagtcactctgagaaagcccagggttaacggctaagccggctgctctctcagcatcctctcttccatcttcctgtttatttcatggcttccatcaccactgaaagttgtcaccaatttgccctcttgttcgtctgtctcaccccccatcaaacatgcccctcacccacccaaccatgagctccatgagaatggggtctcctcactttgttcccagcacccaaaatagtgtttggcccatagcaggcactcaagaaatagatgctcaatgaatgagtgaatgaacgaatgaatgaatgggaacaataagaagaacccatggagagagagaacgggagtgaagggagatggagaggttgcgctctcaaggtgggattttggagtttcagaccatggtgagtggaagtgtcagaacagatccccaggaaataccaggcctccatgcaatattacaggtttttaaatgtagccttaatgtgatttttgcatattgggaataataaaaatgtaagtgatgtctgctcagagcacactccctgattcaatttccactctgttcgtgagtatgttgttaaattgtctggtcccacgggttaacaacaatagattcggagtacgttcaaatcagaaggcacagaaggtgatccagagcagagctttccgatcttttgacagcagctcacaagaagaaatacagttgacatagcgacccagtacctgtgcacaccacgtacacacacacgtgaaagttacaggaaaccataccttcctccgtgcaatgtactctgttattttctgttggttctatttcctttcctttaaaaaatgacagttgccacttttcaacttgacttcataagtcacttaaggggtcacagctcacagtttgaaaatcagcaggtccaaagcctgcaatttacacatggggaaatggagggagacccaagctgggccaatgaccttgctaaggtcacatgggaagttagtagaagagccaggcaaaggagcttctacttccagtggaactttcttccagtgtagacatctggagatctgggaatctaaggatagtagagaaccttggaatgctggaattccagcatcatggacagtgattttgctgtggatggcccctctgttccatcaagtgctcactcctcccccgccaagctgccctctatcctggcacgctgcctgattttcttcataatgtttattgctctccgacaacatctaattagtttgtttccagggtgtctgtcccacccacccgtaccacaaaatgcaatctgcatgagagcaaggacttgtctgcattgtgctctgctgtgtcccgacactcaaaaaggcatctggcacatagtagatgctcaataaatatttgttaaataactacaagaataaatggagcagctggtagctggcatccaggttttgatgaaggcacctctcagaccacatccaaccacaatttattaacaagcagaggaaaacagctccacaagccagtctggaagctcctggactgccagatctcaggcccaactgagactcagaaaatgctttgcttaagaggctccctggggcaaaggccacagtattgcagcagtagaatttgtccagcatccatggtggtcaggacttgggccttttagggatcaaacccagggtgccatcccctagagcaactctggccaatagcactctctatggtaatggaatgttctactctgtgctgtgccatgtggtagtcaccagccacatgtgccaatggagcccttgaaatgccgctagtgtgactgaggagctgaagtatccattgaattttagttaattgaaattgaagtcaagataaccacagtgtgacttgtggctacacatgagacggtgcagccctagattcttaaaccctgcggctcctgcaagggccgggagcagctctgacacattcccccatccacttatcttggaaagcactgctgccactgaaaacgacgcatgtctcacgtccactttgccaagcatcagtcctgacttccgcccgtgaccacttatgtcgaaagttccttgggccagttagtgaagcctctggggttgacctggcataaagctagtggtgccattgaagatgccacctctggagcgtgatctttttgacaatcacctccagagaacgcattcctgattagaaaaactggccgccgccaaagtggacattgcaatgaactaatacatggatgtccccctatctatgcagaagtagcagaaacatgaaataaattaatatgtaattacagttgcaatgggttgcgaaggatgctggcagcgtgaataacaggacagggttgaggtcaaacccaccttccctgagcaagtgatttttaactggagagttgtcctctgcagaggggaaagccaagagcagggaaatgaagggaagcattccaggcacaagtagctgcaggcacagaggtcctggggtgagcttggtatctgaggaacagaacaaagaccaacgtggaaaaccaggaaaaccagcgaggggccagaactttctggctattctgtcacaacaaggatttgggatatttttctcccaccgcattctctcatcctttccctgggatgctggcaggtactgggttaagcaaagctccgtggaagccagagaagccagctgatataaaacctttgtatatgctgtctgctataggatccaatttagtattgatattcccgttttaaaaaataataatttccattagattgagaccagaatgccccgtgaagcccagtgtggtttgccaattgattcacagaatgaaatcttatctaaaatctttttattttatgctattagggacgcaggagggagcagccaaggaaaaaaatctccctgcttggttaatgcacagggtcagctggaagtggccctagggccgtcttaaaaagactgtcatttgcgatttcccactcttttgtttcacattaccagtaattgacattttttttcttcccttcaagtggagttaatggattgacatcttcttgttagcaccttggatctttattgaggactccttcctggggctggcatcacccccaagtgcccttgggaggcctggggtggtccgtgtggtttgcccacatttctcttggcggcccttggcagcaggcggtgggagggaggttgagggaaggagggggtgtgtcccccacccccaagtccacaggccacacggctctgaacctttggaatggcatctctcacgctgaacatacgatgacccaggaaagggcagccttgaagggttgcctgcaggaggccagccttgtgcagatgcgaaactgggcaaagagaggaaaactgtcagcttcgcgtaggcgagaaaaaaagatgatttttccctttcaccccccattttattttcctgtaaagataataaaaagctttgacttccattatacaagtgacagactctcactagagaaagcacagccggccactgcccctggctctgctccagccacaacggcccctagctgttttctgtgcacccttcatttgctgttccccttgcctgaaaccttcttcccccaaacattctcactctctcctctcctcccaatctttgctcgagcatctttttctcagtaaggccttccccacccacacctgcacctgcaacctggcacttcctgtctcctgcctggcttgattttgttctcctaagcacacatcaaccccagcctgatgtatatttcacttagttagatgttcatcatctgtctccacctgccaattcgttttgcattttataattcactgttttatcttcagtgaataaaatagcatctggaacatagtagatgctcaataaaaaattcaatgactagaagaagagggcagaaaaaaaatcactcccacttcttcatattcagcctttggtagtatttggtgcatttgcttcttatctttttctatatataggcttccgtttttatttctacagtggagttccccatacactgggttaggctataaagataaatgcctatggagaaagctgcaaaaatgcccatgaaaacctcttatattgctcttgaatggttttgtctgtacatagagtagttggtttgcatttgggaggtatgtagcatggaaattacatgtctcgaaacaccagagttgtttggcagaaagagatgctctcaggagaggtaggactccgtgaaggcctccagattcacaccacccacttcacactcaacaagtgacaaatagtcattaaactagaggaactgcctgcactgtttaagtgattttttttctctcttgtttctttttaaaaacgaatatagctgaatttatacatgtgtaatgtgcacagaggcaactttcctatacgcagctccaatcatacctgtgaaaataattttaatcctgcataattatattgtactcattttctacatcactctaaacacttcataaatatctctaacagctgcattatctgccatcagggcatcctttcatctactcagcccatcccctattctcctacattgaggttgtttccaatttttcacaataataaataacacagaagaaacatcatgcccaatactctactggatttcagattccttatttgggtcaaaatcagggagatttatgcaagtgggagcccagggaatcagtgtcagattagcaaagtgagtaattgctaggaagatagttttgtcttgaaagtgaggtcagagtgcagctgggtgggctggcgtgcacctgccctctagtttaggccagcattccagggagaaaggactccagagcacactggaagagaagcaacctgaccactagggggagccaagtgggagtctgggttaaagagagatggtattaaccaagatataaattggagcagataaggaggataattaggaacagcattaaaaataatagcatcaacatacatcatcaacatatgctattattttacaaccctcggcccaaggttatggctccgtgtctgtaaagtaccaggcattgtaccagtactatatgaccctcatctctaagcctttagcaaccttacaagggacaaatcactatccttccctattcttgttgcagaagtggaaattgaggctcagagaggctaactgattcacctagcatcacacgcagagccaacattctaactcaggatatcagacatcaagcctcatttctatttctatatcctttaaaaatcaaaatgcaggtcaaaaagatccaaggctatggccaggaagacacagcattgtctagaggacaagaacgtgatggttagatgagagtaaatgatatgaaatgctgagaggtgacacggacatggaggcctccattcatttggccaagagtggtagacttgatggcgtggtcactgccaggtgtgaccatggcatggggtcttgtgccaatgccttccttccacctcctcacttttccccaccctgctttctgcccaagaggctcacctgcatgggctccaccaacaggctcccatgggtgggtgtgctctggttgcgtttggccgatagtgacctttagcaggatgggaggagatacgatgcaaagtagaaatttattccctgtccctggcctgcagagctacctgtgatggctgcctccctcagcccaagtcatggctctgtgaggtggccccctccacgtggctgtcattccaggagcacctctgtgtcagaggcaccgtccccatggctttcctccaccctgcccatactttgtaaatagaaaatcccttccagtgactctgtttagctgtgtccccatatcttcctcagatcctggctgatagagacccccattcatgcacatttactctgtcctcagttttctaaggtgagactgcaaaccggtggccctgttggttgaattaggccatcacacatgcctcgtggtctgtgcagtgcttaaaaatcctttcaaattagtttgcaacctttaaccattgggagagttaatgcaaaaaattctaaaattttggctttgctggaaaacaaagcaaaacaaacaaacaaaaaatggtgggggctccctggccacacggggcttgccttcttctctcaggatcacttttaaccacttgggaagagctttgcagccttcgaggccttttcaggtaccccctcccatcgactcctcttcctcattgacgttacctgcccagccctggtaaacatggagtttatgacagcctctcaagccttccagatgtggcctcaccagcctttatggggctgcttgtgagagaaaccagaactaggagtgggttctcgggcgggggcacagctcagagggcagtcagtaccgaggaaatggagatgcggagatggccatgagcttggcggctgcactgagctggggcagcaaggtcgccgttatatagatcagcctggggagagagagactgtgctttgatcgtgggcaaggttagttagatttgggaatagcagcctctgtaattagcccctggtaaagagctgagaggcaatatgagagcgtgtccaagagtccatctctgcgatattgagttcagatggaaccaaggaattagaaggctctggataaaatgaccacctctgccctcctctctgggctttcctctagagctctgggggcaggtaagcgtgagagcatgcccttgaccttctaatgagatgatgctgcaaatttcctcccaattggcttatcaagtttaccagctcccactcacccagtgcaagctttggcccagagagagctcccttcattgtcaacatgccaagaaagcattctgaatggttcccaacacacacgcaaatcccagcacaagagagacgtggagggcacatggaggaagacagtttgaggtcctaggatctgtggtcagactgggagctgcactgcaggacaggcctccaaagttggtcacagagcccctgagttggtatccatgatcttctctcttggaaaacttagagagagttcagttttgcaagcacctgaaggatgcttcagccttggagtctgcaatacagtagggtggtcactgtcatcaacatcagctgtgggagcctgacagacttcaaactcatcctcgttccttaaagccagtgcctttagcaatgtcattaacctgtgtgggctatttcactatctgtaaagcggacggtggtcacagccactaagtccttgctgctcagagtgtggcctagggccaggagcatcagcatcccctgagaacttgtagaaccacagaatctcgaacccagccccagcctcactgattcagaatctgttttcacaggctctccaggtggttttgatcaaactcgtagggcttttgggaggagtatatgcagttcaataatgcaacagttttgtttgtttgtttgtttgtttgttttagatagggtctggctctgtcacccaggctggagttcagtggcgtgatctcactacaacctccacctcccggactaaagggatcttctcacctcagcctcctgagtagctgggactacaggtgtgtgcaccaccatgcctggctaatttttgtattttttgtagagatggggtttcaccatgttgcccagactggtcttgaactcctgagctcaagcaattcgctgccttggcctcccaatgttgggattatagctgtgagccaccatgcccagccaatccaacacatatttcttgagcacttactatgtgccaggcttggttgcaaatgctgggagtacagcactgaacatggcagatgaatcccagccctcaaggaatttactttctaatggggtgtattagtccatcctcatgctgctaataaagacatacccaagactgggtaatttataaaggaaagaggtttaatggactcacagttccacatgactagggaggcctcacaatcatggcggaagatgaaggaaaagcaaaaggactttttacatggtggtgggcaagagagcatgtgcagggaacgccccttggtaaaaccatcacatctcacgagacttaattactatcacaagaacagcacaggaaagacccgcccccatgattcaatcacctcccactgggtccctcccacaacacataggaattgtgggagctacagttcaagatgagccaaaccatatcatagggagagacagacaaacaagagacagacaaacggacaagatgaaaatataaaatacaggaaatgggggatggtgctcagtgggaaggagaaaaataaagcagtgcttccaggtgggacccggcagggagaaggactataatggcaagtagaatgacaagaaggtgacatttgaacagtcacctgaggaaggtgaggaaaagtatattccaggtgaccagaacagcacagacgaagtccctgcagcagaagtatgcctgctgtgttggaaagatctgtcaggatgtcagtgtggctggaataaagtgagtcagcagaagtgctggaaggtgaggtcagggagaagtaagagcaagggcggatgatgcacagctttagaagctgctgagggtcctggcttgtcctccagttcctgatgcccaggaatgggcagggacccactggagaggggctggaagcagtggctggcacgtggtaagttcagggaccagcattattgtaatcgttgctgttatccaaagctgatagaaacaggttggactcacccttgaggtttcagcttaggtgtcccttctccaggattgctgacaccccaggctggagggggtgcagacctgagagcacctcagccttctgaaagctcctgggtgaggctgggatggggagctggccagccctattcacgatcgtatctcagagcacaacactgtacttggcatctagtagttgctcaataaatacctgtcaattagaggaatgaatacatacaaagacttgggggtgtcgggtgggggacgtgctcaggaaaggtggggaagtggctgggaggagtgacaggagtattgttagaagtaaacacctgagctttgtccattcaaggtgccctctggagcctgacgcccaggaacgaacagggtcagggtgttggtcatctctgatcacactgctgggtaaggtaacccagaggccaccaggactctgtgccaagaaaccctgggcctttgtgctgaacttggcaggcttcttgtcctcctctggctcatttcagggccaccccatgctttagcccaggctccaccatgaaactttctcccccacggaaatgcttgggcactgctggtaaaaggatggcccctcaggagagccaccaggcagcactcagagaaagtgacaatgcacaggctctcaacaggcagcccaccctctggggcagggcccagagcagcagttctcaaccttggtgatcttgcacccctagggacacatggcaatgcttggggacatttttgtttgtcacagctgggaaggaggtgctactggcatccagtgggtggaagctcagggtgctgctaaacattgtccaatgcacgggacagctccacagtgagaattatccggtccacagcgtcaacagtcattatcccttaaggagccttttaagattttttttttctaattccccctttaatgaaattttagaactatagagatattgcatacatatctgtttgtgtgctgtaggtatatgtgtgctttatacataaaaaaggtaagatttggctgggtatggcagctcacgcctgtaatcccagcactttgggaggccgaggagagtggatcacctgaggtcaggagttcaagaccagcctgaccaatatggtgaaacgctgtctctactaaaaatacaaaaattagctgggtgtgatggtgtgcacctgtaattccagctactcgggaggctgagacaggagaattgtttgaacccaggaagtggaggttgcactgagctgggattgcagcactgcactccagcctgggctacagagagactgtctcaaaaaaaaaaaagtaagatttttaagtgtccattgatggatatgaatagtatgaatagataaacagaatgtgctattgtacatagtgtggaatattattcagccttaagaaggaaggaaattgtggcacatgctacaacatggatgcatcccgaggacactatactaagtgaaattagccagtccccaaaagacaaatattgtgtgattctacagtatttgtagaatattgtatgatgtacctagcgtagtcagaattctagagatagaaagtagagtggtggttgccagcgtctgggagggcggggaatgtggagttagtgtttgatgggtagaaaagacttctgtggatggacagtggtgacagttgcacaagaatgtgaatgtactcaatgccactgagctgcacattttaaaatggctaaaatggtcaattttattttatgtgtattctgccacaattttaaacaaagagtattccgacgcgttaagaatcagttctcgcccgccagggggctgtatcacccccattgagaattcacagcctagagatccttgcataggacctacaggtgtggatgttcatcgcaacatggttgggggtggtgagagctgcaggcaccctgggagtccctccctttgatggtgggagaagttcttaggaagaatgggcccacctggacaccgcaggtggaaaagctggcggagagatgctcttgctcattgctcagaggcatcgtgaccgccccacactcatactctgcaggtttttggaaaatccaggctgggcgcgatggttcacacctgtaaccccagcactttagggggctgaggcaggaggatcgcttgaggccaagagtttgagaccagcctggacaatacggtgataccccatctctacaaaaaagagaattaaacagacatggtagcatgcacctgtagccccagctactcagaaggctgaggtgggaggatcactcgagcccagatgttccaggctgcagtgagaacccctgcattccagcctgggggctggagcgttatagtaggtagctggtcaggtatgagcagggcaggagaggatcctcctcaacacacaccaggagtgtcacgcaaccatcaggtgacggtcaggcagttgttaactggctttctaaagtaataattggccacagctggcatgagggaaaggcagtcccttaatagatagaaaacacctgaaatgggtggccagaggcttcccaataagatctcaggagtggtgagaaggaacgcaggacccctgaggcttgccaccatatcaaaccccaagtcaagaggtcaggtcgcacacttggtctctcgagttgcccgcttggccctcttccaagtgcacttccctttctttcattcctgctctgaggctttttaataaactttcactcctgctctaaaacttgcctcagccgctccttctgccttctgcgcctcggtcgaattctgtcttctgaggaggcaagaactgaggttgctgcagacccgtacagataactactactgctaacaagagtgagaccccatctcaaaacacaaaaacaaacccatacacggccaaattagcttcctcatctcctctagtcaacaactcaaactgaatttttcaaactgacctctttgctctcaaaattctgtttttgcctttgttgcttgaaacaatctaggaacatgagtcttcttcatgtcagagctaaacagcatgcagataactagctaaatgtttcagagtcattctttgaccataagtaaaatgtgccaggtgtgcactaagcatcttatgggatggttacaagcagtgccccagatgtgtgcacagcagtacagagaggtcttgacaacacagctcaatgccattttacataaggtaaaatagatgcacacaaagcaattataggtattttgcaaactgcctacaaacaaaaggataactcaagcgtgccagggggaagcaggtgaatggggaatggagattagaggaactaaatagatttataaacacgagcacagctgtgggttgctcccaagatgaaaaacaaaacaaacacacacacataaacaaaagagggagtctatcacataatgtggcacacttaaaacacacacacatacaaaaatgctcgcatatgttatcccgaatcatacaaaataaaagaaaaagaaaacacatctgggcagctgacagtggcaggagttggaagcaaaggatggaataaaatagaattaacacatgaatgaacaaatcaaccaagggttagagcttgtctgaaccaattatgacaatatgtcattgaaaggattttttttttttttttgagacaggatctcactctgttgcccaggctagagtacagtggcatgatcatagttcactgcagcctccacctccggggctcaagcaatcctcccacctcagcctcccgagtacctggaattacaggagtgtgtcaccatacctgcctaattgtttaattttttgtggagatgaggtctcactatgttgacccggctggtctcaaactcctgggctcaaatgatcctcctgtctcaacctcccaaagtgctgggattacaggtgtgagtcaccacccccggccgacagaggaatttgactaaccctaccttcattccccaaggtccataaagtgcccaaatagccatataaagcaccattgcagattcacctgcgttagttaagacctgttagttacaaccaactgatacccaccacattgcctgaaacccctacagggccactttcttataaagaaggcgtggggtgtcctggagccctgaggctgcgaggccagttggctttatgccagcttgactcagagggcacctatctctgtggcttctctcagtcttcctctctgggtctctgctctcttccctccatcttcggacccactttctctgcttttactcacagaataatagccatcctttcttgtgctatttatttgcaaataaatgctaccatttatttgccagaataagttaaagctttattcgttggcttggagacatttctatgagatatttttgaataagaaaaaagaatagaatgtagaaaagagtgtaaaatagaatcccatttttataaaacaaagactgatggaaaaatcccaattaattcgcgtatatttgtgagtctatacatatgtatcacataaaaacacagatgcaaatataagcacaaataaaaatagtttgaaagaacacatgctgggttgttaacctgggtctctagcactgggccacagggataatgtagataaaagagtgaggaaataggaataagggaataaggaatgcacatcattacatgtattccttcatgtaaaattatgtataaagagattatgcaaaagattgagagagagagagagaaacataaaagtgaagtgagaccaagattcaaatctttacgtcacattccacattcccagggaaggactctgattggtccactttggaccaatcaactgtgaccaggaagcatagtcattggatataagtattaatatatctgttcccacttcatctgtgcagctaggggaggaggagaaaagtccagaaacctggggggtgggggaattagtcacatgaagtaacagtttccactagtttttgcttttttctctgcattcctggaaaccttaaaaagaaggattggagaaggaagggggcataaaacaagtaagatctcagggaagcttagaaactaagccagtgaatgaggtggggacagtacacacaaaggttctgtgacaaggccgagcctggaaccatcaggggtctttaagtaattccaggtggctggagaaatactgagagatgggaggagaaaatactgagagatgggatggaaacagaatcaagccaaccatgaaggaccctgggcatccctggtgagtgacgggttcaacaagtttatgggcaggtcaagatggtcttacaagccatcagaaagactccgcttttcctggaatgagatggaagccactggagggttttttgtttgtttgtttgtttgttttcagatatagggtctcactgtgttgcccaggctggagtgcaatggggcaatcatagctcactgcagccttgaactcctgggttcaagccatcctccccactcagcctcctgagtagtactacaggcatgcactaccacacccagctaatttttttttttattgttttctttagagacagggtctcacaatgtttcccaggctggtcttgaactcctgggctccagtgatcctcccacctcagcctcccagagtcctgggattacaggcatgagccgccgtgcccagccaggttttgagcagaggcaggacatagttccacttaggttctaacaggattctctagctgctgtacagagaagaggctccccaggcaaggacagaaccaggagaccaatgagaaggtgaccgcagtagttcaggtgagagacggtggtggcagtggacaccagattcgggatgctttttaagattagagcccacaggatttgttgatggaccatttgtagggtgggacaggaaaagaggcccaggaaggaggtaccattgacatttgatcccaaaactcagccagaccagattgaaaaacagattgaagttggtcactcgcttatctcgaggagtttccaagatgagagtttcagcctgtcaccccagaaatacagtgaggccattagttccccatcttaatcagatctctcccatcctattaagcaatttggggccatatctggagaagattttgttatttacctaaatctctggctgcttcatttagacctggtgtttaggcggaatgcaattaacacattccaaacctggtttcccctaaaatccaatcaactgtaactcgttttcaaatcacactgctttctctaattgtgaacctcagcctccgcagaatagcgatttaagtcaattattgcctcgcttgtatgaaaattgtgctatttatgttggcagctccccacattactgatgagcttcctcgagctaatggaataatgaaaacacaaaacagatttaccattcttaataagagaaagagataatgaaggcaaattaaaatggaggctcagatctgcatggagaacaggtaatgcagtttcttctttgaaattaacactcgaattctcaaatgccaatggcagggagggggaaagaaactcaaaattcctttagacacaagtgtgccacttcagcttggttttgaagattgtggtcctccccggcactttctggagtttagatatgggacgctgtcagcagccatccctgctggcacaatagcccacgcgctcacctcctcccccatttatgagcgaaaactcgctttccaccagacacgacgttcagctctctcatgccttaggtcattagatcctctccaagttctatgcgctcagtagcgttatcattatttcacagaagaaccagttaaataatttatccaaggcttaacgctgcatgtgaatctagcccagggtctcaactgattgttgtttgaggctagctaattctttgtagtcgggggtgggggctgtcctgtgctttacaggatcattagcaacattcccagattctactcacaagacaccagtggcagccccatacctccagtgatgatgaccaaagatgtcttgagacgttgtcaaatgttctctccgaggcataatcacccccggctgagagctgctggtctagattgtgtgcttgtcaatcaacccgaacagccagtcttgccggtgtaagcagcaagaggctgaaggtcaggaaacccgcatcctggatctgtccccacctcacattgtggcccagggaaagtcacagttcctcatggggcctgggtgttctgacctgccaaatgagtgtgatggcactgggacctggaacctggcttggctaaagaagtttggccaaggtcattgaagaccttggtcaagtgagaagcagcaggccaaggtggggcggtcacaggggggaaaggtcagagagatgtgaagggcagccaagccagagggtctatattggcaagaagcaaggtcagctgcggtcagaggggccagagacctgcaaaggccagagctgactccaggaggccgggagagctgaacatctgcctccctccctcttcctgcaaaggccagagctgactccaggaggccaggagagctgaacatccagctccctccctcttcctcctctgcaccaggcattggggtcttacacctcattttcctgtgcttttgctgtgcactttcccatttactacaaatagatgcttctgggcctaattctggggctaatgagactcagactggtgattataataaatataaaaatgatagaaacagatacgaaatgctgtgcagagccctccactggcttcacggcctgcatcctcccagcagcactgtatccttatcgttattagcccagagggacagcccattgctaggtgtcacagagagaaaggagagaaaagagagcctttgaggccgaggagaaagaaagaaagaaagaaagaaagaaagaaagaaagaaagaaagaaagaaagaaagaaagaaagaaggagaaacttggtggtaatggttgtcatttattgaatgcatactgtgtgccaggccctgttctaagcacctgacttggttttgctcatttaatcctcaccatcacgtttaatctccacttcatagttaggcacagagaggttaagccagttgccaggtttgcacagttaactagtggtagagctgtgatttgaacccatagtctggctccagattctgtgctcttgacagctgtccctcagagctgatggctctgtgctgcacctgggaaatttagtcctcagccatgggggcccctgaacccacccaaggttttgtgctttaaacacagcatgaatgattggggcctcctgtcctggagggaacatgtgggaactagacaacccattatgtagggactttgcactgataacagtgcccccgcccaccactcccatggcttgggctacccaggatattcgcacaagcattggttgggaaccccaagaaggactgagtttggcctccccagcagttcactgacttgacacatggcttggagaccaaaagaaagtgcttaataaaaacaaaacaaaacaaaaaacacctgagtttgtgaaccaagaataatccaaggacgatacttggtcagtaagaaaagtgcccagcatggaggttggcacatcgtgggtgctcagtaaatgttagtccccaccttgttcctgaccatgccatcaccacccaccccccgccttgcttagggcttaccccgctgggtgggggtctgtttggggtagcttgtgcagtcatctaactggtcccatccctcacttgcaacagaccgcccctgcttggtagctcatctttcttttctgaggctaatgcttggctgtgtgacctttggcagggtgcttgacctctctgagcttccacttcctgggaggttgggcagaatctgtggattctctttcaactctgaaatgctaggaatctccactcggctctctcttgcaaccctcttctctcctcttccctccacctcctccatctgtatctgtatctctttccttctgtctataccaagcttctccaacctgtggtctaggacagctttgaatgtggcccatcacaaattcgtaaactttcttaaaacattatgagatttatatttgcaattttttaaaagctcatcagatatcattagtgttagtgtgttttatgtgtggctcaaggcaattcttcttcttccaatgtggcccagggaagccaaaagattgaacacccctggattctggactcttctccacacacctctgggcactgctctgagcctctttctagatcatgatttcccaggaatgggggagggcaggatggagaggaccattcccccttttccatggggtggcactgcccaagagggcttcgggctagatacccgggcgcgcggcttgcgttttcaggaagcttgtagcacaggtagatctcagctgacgtctagttgacaagctaaatatttacggagctcctaagatttcccaccacgttaagcccattgcttgatctcacgtctgcacacagcccttctctattcaccttcagtcagacgtttcccagaatcctctgggttccaggcaccatctctcaggagggtgatgaaaccatgtctgcgtctaatcaattccagtaataataataattccttatcgttgtataggatttctcaaagcacgtttgcacacattatctcactcgcttttcacattaaccctgtgacttagattttattttgagtcccattttggagagcatggctgagccacctactccagggccagcgtgtggcagagctgtcaggatcctccctcttgtcctcccacggttggcaaggccagctcactcacatccagttcatctctgggccccaggacaagagtataaatggagcccgacgtaccatgtgtctaatatttaaaagttataaacaaagctaaacatgtttttttatcttcctaccttgactaaaatacctggaagcccaggttcaaatttagagatcttgggccgggtgtggtggctcacgcctgtaatcccagcactttgggaggctgaggcaggtggattacctgaggtcaggagttcgagagcagcctggccaacatggtgaaaccccatctctactaaaaatacaaaaattagccaagcgtggtggcgcgcacctgtaatcccagcacttgagaggctgaggcaggagaatcatttgaacctgggaggcagaggtcagagtgagttaagatcaagccactgcactccagccctggtggcaaagcaagactttgtctaagaaaaaataataataaataaataaatttagagatcttgggctccttggggtttcccactggaatgtgctagaagccataataaaaagcatggcctttttagtttcataaactaaaaaatttgctttatgccacagccagtttaagttcctgtcatttataggaagagtcctgataatgcggttgctgtggaagacagaccaggggacaggagggaagggaggccaggcttcccctggtgaactgggaagatcagagacccacagtagttcatgatgagacctttgagaccaacggtccccagcctttttggcatgaaggactggtttggtggaacacagtttttccacagatgggggcagggaatggtttcaggatgattcaagcgcattacctttacggttcactttatttctattattattagattgtaatatataatgaaataattatacaactcaccataatgtagaatcagtgggagcccgagcttgttttcctgcaactagatggtcccatctgggggtgatgggagacagtaacagatcatcagacattaaattctcataaggagtgcacaacctagatctccatcatgcgcagttcacgatagggttcgaactcctatgaggatctaatgccgcagctgacttgtcaggaggcggagctcaggtggtaatacgactggtaccaggctctgacccaggcactggggacccctgttttagataatggaatagctatataaagtttaatcaaagaagaggaccaagaaaacttataaatccttgcaccacatgcacccacaccatgcctttgtaagataagaaaataatacaggaatactgtcaataccttgaaattctcaaaccatagctcaccttcatagaatatcaaagctcatttggcccagtctctctatcttaccaatgaaaaaaatggaagttcagagaagggacccgctcaaggcctccaagctggtgagcagcaggaaccattcatcaggttagcaaatatttcttgatcccatatcacatccaagatctcatggtaaacactggagagaccttgggatccaccacctgtctttgcaaataaattttattgaaacacagccctgtctatttgtttatgtattgtccagggctgcttttgcattacagtggcagtgttgaatagttgcaggagcctaactcttaccttggcctgcaaagcctaaaatgtttaccctctggctctttgcaaaaagtttgctggccaggcacggtggctcatgcctgtaatcccggcagtttgggaggatgaggcgggtggatcacctgaggtcaggagttcgagaccagcctggccaacaagatgaaaccctgtctctactaaaaatacaaaaaattagccagatgtggtggcaggcgcctgtaatcccagctactcgggaggctgaggcaggagaattgcttgaacccgggaggcggaggttgcagtgagctgagatcgcaccactgcactccagcctgggcaacaagagtgaaattctgtctcaaaaaaaaaaagttttcaacccctgcaacaggaaataaactaggcatgaggttccaatctagagagatggaaatagtacccaaatatcattccacaaacataggcaggcaggaaacgaacctctctgtatttctccagggcaatttgagtctccatttttggggaatgttgaaatcttagtttcatcgagttgaggctcctgcactttccatgggtgaattctgagttcatgcagtgccaagtatttgaaggaagtgggtgggggctggccttggggtgacttggccatctgtcatgctttggtcctcagtcactgtccacacagtagctgtggggttcccatcctcagggcacctgcagatccagagattctctgctggatccttgttgccctcggctcacagatattaatcatattcaactgctcccttccaagctgtggggtgaggactttggtgagggccagactgcttggagcacacacctgtgcctacagccacctgtcttctggtcttctgctacctcttcacggctctccccatgctctggacacagtgctgtgctccggatgtctccaggcacactcacacctctgtctgcttttcatcacccgccactaccaccaccccactccaagccatcgttgtcccctctctgggccatgacagtggcctcctgcctggtctttctaatcacaacctgctctccatggttcccaaggtctattagccctgggcagccataataatcctttaaaaatggaagtcatctctgccactcctctgctctttaacccctcacccctctacagtcagcatcccatctgcaatcagcatcaatggcttcccatctccaatcagcatcaatcctaaggtctttgccatgacttctagggctccaaataaaccaaagcgcttttgtccattgaccctactgagccatcctcgttccatccaccccaccccagttaccagtcagacaacatttcctaacacagtaagtgttggctactgtttcaatttttttttttaccctgtctcccaggctggagtggaggaaccctctgcctcccaagttcaagcaattcttctgcctcagtctcccaagtagctgggactacaggtgcacaccaccattccccgctaatttttgtattttttagtagagttggggtttcaccatgttggccagactggtcttgaactcctgacctcaagtgatccggctgcctcagcctcccaaagtgtgagattacaggcatgagccactgtgcctggcctgttatgaatattattactattaaaaaatcagggaaattacatttttctatatgtggagtacgaactgaggttttgacctgtttacatgtctcatgagagggaccttgggttctgactgtctacaaggtgatataccctgtctagaagcttcccctgcccccccgggagacccaaggacccctgggtcacaggatcaggctttctggctggtcgtcccctcagaagaggccagggctgcaatcttgtcttaagaatctttattggaaaataaacaccgttaatgtacaagaaatcccatccaagggtccagtcaaaacatctctgtgtggactgatgccatcctaatgggctccagatgtcctcccgtctcagtgtcctggtgacctgagggagggaggtgggccttgggggagacacgtggcaggtttggaacctgagcagggcctctttgctgccccagtttctctctgtgtgggaaggtttgggggacctcctgcacccgaccctgtcccgtttcaccagacccccgtctgtctttgccctcagcggcctctgcagcttccttctcctgagtttattcatctgaccacaggaaatgcccagcttgggtggatccgatttcacttgaaattgaaactggaggtgactccttccggtcagctgagctggaggccatgtctatgccaaagcaagccagctcttcccagagaactgtggaaggagctgcggtggggatcgggtattaggagggagggggcttggagagatgcgtcagaggccagaaaggaagacacaagttgggggttcgaaagacaagctcagaaatgtctctactgataactttcttgaagattactcttcaaaattacggccttacgatttaacacctgagctgaccccagctctctctgagacctcatttcctaccacacctcccagcaccctctttgctgcaaccccactggcctgctcgctcttcctccaaccaggcaagaacagtcctgcccccgggtctctgcagttgctggttccatcacctggagagccctttccttaaatatctccgcggctggctcactctgttcagatgtccctcctcagagatgctctccctgatggccaggtctagaatatctgctgcctcccctctgcctcgcgcttctgtgtcttttctcttgtctcgttttccttcacggcacttctcactacctgctactagacgacgtatttcatcgtctgttgatttgcttttcctgtctccctcgctaggctccaggagccaccgggggcttgttcacgcttgctgctgtggctccagcagtaagaacggggcctggcacctagtaggtgctcagtcaatagttactaagtgatgctatagtgatacattctcagcgtaaaaatatttaaacgatccaggtgatgaggtcaggagttcgagatcagcctggccaacatggtgaaaccctgtctctattgaaaatacaaaaattagccaggcatggtggtgcacacctgtaatcccagctacttgggaggctgaggcaggaaaatagcttgaacctggaaggcggagattgcagtgagccgagatcatgccactgcactccagcctgggcaagagagagcgactccatctcaaaaaataaataaataaacaaacaaataaacaaacagtccaggtgagctttttaaaaaataatccagcagatgggtccttgaggcttcacccccacctcaactgcccccaaccccactccaccctaccctcagtgtccctggagtctggagcaggcggctgggcccctgtggtggtataactgcctgctctgctccacgaggctacagagggcttcatgtggatgtctgtttcccttcctcacacccacgtggctgtgactgcaaaggaatggcgactggacagcgtcttgcagcaaccaaggcaatcacagtaatcctggccgatagccctagagccctatctgagcctcacaacaaccccagatggaggttacatcattaccccatcaacagagaaggaaactgaggcacagagcgattcaatgtctgcccagggtcccatggatagcaaatgggggagctgagagctgaagcccagtattcccagttgggtattggtcccaggtccacatgaggccaaacccaatgtccttccctttacacgaagcatcatcagtgtgctctggagccaagagaaattaagcacttgcattcgatcctccagcatggctctgccagggaaagtggccgggagaggacacttacctctggggaaaggagaggaactgaggctcacagactaatgaatgtgtaagagtcttaggtctctgccaacctcagtggtcagagtccacactacttccccttaccagattactgccctctgttagagtcattcttcggggggagctgccaggaggcctgtgtattctcaccaggcttccctccctgagagaagccaaacgtataaacaactcatgatttgtgtgaatttcccatgatgtacccaatccaagtttggctataccaaatagatgaaagcagagacttctagaaatccaaccctgaggtcaggcgtggtggttcatgcctgtaattcccgaggtgggcagatcacttgaggtcaggagttcgggaccagcctggccaacatggtgaaacccgtctctactaaaaacacaaaaattagctgggcatggtggcaggtgcctgtaatccgagctactggggaggctgtggcaggagaatcacttaaacccaggaggcggaggttgcagtgagccgagatcgcactgcactccagcctgggtgacagagcaagactccatctcaaaaaaataaataaataaaataaatcgagccctgaaaggcacttggaaaccatttacccactctccccttctctccttccattccactctcactgctgttcccatcacaccaggtacagacgtaccctccctccgggcctgtgtgcttgcccagccacccacccagaacgtgactgcccccctcctgccctggctcacatatcaccttctcagtaaggcctttcttcacctgtcatgtcctgacataccaggtgctgcacttatttttgcatttaatatttgcttccaccttctgggaggtcaccttcacaggggcagggatttctctttcctcgacttcctgcagtgtgtcaaatgccaggcgccaggagatgcccaacacattagttaaaaaattgatatccaagagcctctccttttacaggtgagcaaattaaggaccagcggagggaaggacttgcccacgtccatccaaccaactagagcctatagtcattgcttagggccgtcatgacaaattgccacaatcttggtgccataaattcctgccaaaacaatagaaatttctcctctcacagttctgaaggtcagaaatcccagatcaaggtatgggcagggccacactcccctgcaaggctctgggggagaattcattgcttgcctcttccaacggcaggagatccctggcttgtggctgcacctctgtctgcctccatctttacggggccttctctgtgtctctgcgtccctctccctcctcttataaagacatcagtcattggatttaggacccatcctatcttcagggtgacttcatttcaagatccttagataattatgcctgcaaagatcctatttccaaataagctcacattctgaattttgggggacagtaggcaccctcctacagaggcagagctggcaagattccaggtctcctcccaactgcagcccccatggggacttcacaaggaactcagctttcagggagggcgttggcggccagcggctgtggctgtcagtctcccacgtacttgtcaagaaggagatgaaaaaaataaactatagggttaatgaaagcggcaagatgacctcggctgatccccgtaatcccttgctctaagcctggctttctatcatcagtcaagggttcttttttttctccttcttcagaaagtttctccagagaagcagcccttccaaatttaataaatctccccgcccccagctttccctgaaataatgaaccggcaggatgattttcaaatgtctgtctcaacgctgtgacgaagaatccccaggaaaaaactgcaggggagagggaggtgtgcagactggggctgtttgtggctgaggatgtgcacagatgcctggaagtgtgtgtgatggtgtgtgcagcgtgtgtgtgtatgtgtgtgtgtaaggagcatcaggcctgtgggacggggatctgacagggactgcctacattgaaagtgtgtgcacgtaggtagacacatgtgtgtgaacatgtgagtgaaaaaatgagcacgtgcgaatgtgcacgtgtgtgtttgcgactgtgcgtgtgtgtgtgcatgtgtgcgtgagtacatgtcagagagaacgtaagtattagagtttatgtgtcaggcaaaggtttggaggtccatgtgcagtgtgaggaaatgcctggatgcctggatatggaggtgtgtgtttattggatgtgagcgtgtgggtgtgcaggtgtgtgtttattggctgtgagcgtgtgggtgtgcaggtgtgtgtttattggatgtgagtgtgtgggtgtgcaggtgtgtgtttattggatgtgggcgtctgggtgtgcaggtgtgtgtttattggatgtgggtgtgtgggtgtgcacgtgtgtgtttattggatgtgtgtgggtgggtgtgcaggtgtgtttattggctgtgagcgtgtgggtgtgcaggtgtgtgtttattggctgtgagcgtgtgggtgtgcaggtgtgtgtttattggatgtgagtgtgtgggtgtgtgggtgtgtgtttattggctgtgagcgtgtgggtgtgcaggtgtgtgtttattggatgtgagtgtgtgggtgtgcaggtgtgtgtttattggatgtgggtgtggcgggtgtgcaggtgtgtgtttattggatgtgggtgtgtgggtgtgtaggtgtgtgtttattggatgtgagcgtgtgggtgtgcaggtgtgtgtttattggatgtgggtgtggtgggtgtgcaggtgtgtgtttattggatgtgggcgtgtgggtgtgtaggtgtgtgtttattggatgtgagcgtgtgggtgtgcaggtgtgtgtttatgtgcatacaggccaatgtgggtgtgaatgtgtgtatatgggcctgtgggagttagggtatgtgagtgtttggtgacggggaggtaactctgaacatcacattaatatgactcataacaatacccaaagcctttccagtggtccagggtccctacacagtctgtggctgccccacttcccttctgaccttatggtaccgccttcgccttcgtcctctctcctccagccgcacgggctccgtggtgctccctgaacacagcaggttcatccctgatgagagtctctcatggcttcctctctcaccttttcctggctctgctctgtgtcatcttaccagagcgccctgctgcagccactgctgccctcctccggaattccccatcctccttccctggagtgtggcaggacagaaaggcagaccaggaggtgggagtgcgggtgctgaccaaagttggtaacttcagtagaatctcactggcttgacaagataacccaggtcacataaaattctttgctgttgggaagtctttttagaatgtttggctagaggggagtttagaaatcatctagtttcatgcttctttactgatttgtgatcatgaactatcattcatcttctttgggtaacaagtaacaaaaatataaaacctcaaactggctgaagccaaaaagtgtatttgttggcttatataacttctgggtaatgcatttccagaagtagaactagcttcaagcttggctggactcagtgacttaaactgaatgcatgtccatcaggacgggtccttctccatctctcaactgtttgcctttgtattggctttagacctctggagaccttctttgcatggtggccttgagtagcattgggcatttatccaattagcttagcaacccgagttcatatcactgcagcaaatattctgagacgacactcattggcctggcttgacacatctgctcacaccagaaagatggctccaggcacagggtatagtgagcagctgctatttttggaacccagcacactttcaccatataggagagccctaagtttcctgcagcaatttacctccccaactcgcagtccataagctgaccaggcaatcagtgtccctggccctagtgactggttcaggggagtcctatggcttcagccaagccaatcaagccaattcaggggaaaccatggcttttgctttccacacgagcaaaggtgttagagtctcttcctctctggacttgatgttgtgagggtgtcaggccgaaggtcagtgcattaggccattcttgcattgctataaaggaatacctaaggtgggtaatttataagaaaagaagtttaattgtctcatggttctgcagactgtacgggacgcatagtgccagcatctgcttctggtggggcctcaggaagcttccaatcatggtggaaggtgaagggggagcaggcatctcacatggccacatagggaacaagagagagagcaagaggagggcctgcattctttcaaacagtcagatctttcgagaactcactcactatcatgaggacagcacgaaggggatggtgccaaaccattcgtgagaaaccccgcaccccatggtccagtcacctcccgccaggccccacctccaacactggggattgcattgcaacaggagatttgggtgggacagacatccaaatcatatcagtgagtcagtcatcttgacaccacaaaggaaaatcccatgagggtcccaggggaggcggccctgaaagatgaaatcatgtgagcatttgcagcaagtggtacctggagccggccaatccttctgagcttttgcactataaaatccagtcaatccctacagggatggagagtggttgttgaatgggtacagcgtttttgtgtgggatgatgaaactgcatccatctggagatgggtggtggtgatggctacacaataccgtagatgaacttagtaccactgaaacaattgtgcattgaaaaatggttaaaacggtaaattttattatgtatatcttaccacattttttaaaactacaaaaaactcttaataaattcctcttttgtttaagtctgtttgaattgtggttttactcttacaaccacaagtccaggtaacactaaagacatgacttcagcttatttatttattttgtaaaaaatacccaagcatatttaaatatatctgccctgtgtcctatcccctcatgggttccactggcaactaaagaaacatctggactaaggttttggcaggcaccaatgcactactcttttctgggtaacacttttgtgtatttgtagagacttctggaaggagtgcttcgaatcctaaagcgtgcctctagtggtagtgctgaggcccaggcacataggaggctttcccacaaatccacaggtagattcactcagcaaacaagccctcactgacaccccacctgcacctgggagtggcggggctcctgcacactggccagcagcctctgggcattccccattccatagtagaggcttctcttccccctacaaggaacctgagtgtggcagggccagccaggcaagtcctacccacccacccactctgcttggccctaagcacctaaaaatccaaccagatttttatccctcgggccaatctcgtgtgatttcctggtgacaggtgctgtcagatcctgaggccatggtggggcaggcagtcggggctcccctcccgcctcaccttatctggctcccttccctgccttccaacctctaaatggttattaacattacaagcagcattcctgagccagctgtagcctctctgatcggtcattgatgccatgatagacagaggatcctcctctcccttcaggggctgggacatatctgcccacgatccccccctctccaatgaccgaagttttacattatctgctaattcactcattcatttacttgttcattcatttattcattgtggcccctgcagcctctctctgtcacctccctccttcctgcccctgcaagcccgcccccagcctttgcccttgctgttccctctgcctagagcacccttccttcagagcttcccatggctacctgcttctcgtccttcagctctgggtcagacgtcaccacctcagagaaggccttgttgaccaccttgtctaagatgcactttgcccctcagacatctaaattttcactctactcatttcctccatggcatcagcattatctgatcattttcttgtcagttgcatctggcgtgcttgttgatgatctgtccaccccaaccggaggaaaaagagtaagaggggcctggatacttctatgtttctggaggtcagaaccaggtccagctccaaactggtgtttagaaaataattgttgagtgtctttggttgggtctccccagaagcagaccctgagaccgggattcaagctcaagaagtttatttgggaggtgcaggaaatatcagtataggagagggcaagtgatgtggggaaggaaggcagcccatgcagggtgccatcaagcagctggagcttagtcccactggggccctctgggtgactctgtagctgggtgacacatctcgaagctaccccatctgggcagtgaaatagctggtgtatttattttcaaactccctcagtcatgagtgaccactccgggttgctccctggaaaggaggaggcattctttccaggtgcttcctgacctccataggcacagcagggctcatctcagagtcctgtgaaagcccgcaggcaaagggatgcaggtgctgctggctagaagtcaggctggggtgcactggggtaaagaccaagggggcacaggtgggagctgtcaatatctgccaggtgaataaacgaatgaatgaacaaatgcagtcattcattcattccatcagcctgaatacctacaacataaagtgttgccaatggagtgatgatttagatacacacagttcttgtctttatggagctggaagtctgagaaggggaatgggaggaacaagcaagaaacagaatcacaaatgtaattgtttaatttcaattgtggcacgggctcgggctccaagatgaacaggagctctgaatgtttgcaaggtgggtgcctgaggctggccaggatggtaggatctccctgagaaggccacattgaacctgagccctggtgaataacctggagggacagcaccacagacaggaggaacagcattacggaggctctggggagagaggagcgatctgttggggaatcactgcaggggagtacatgtctctgcagacttctgtttccaattgcctgctccacatctctactagacgtctaataaacatctcaaattaacacagctgaaaataaattattagttttccacttgcagacttgcttcccttccacattttccctgtcccagtccatggcacctgcactctccccagcttctcaaatgtcaccctgtcaagaagatccctctgaccacccataagaacatgcagtaaagccccaccacagccttccatctccccaccctactttgcttcttcatggcactgtcatcccctgaccaattatctgctgtatttattgtttgcctcgctgagatggaaggtccctgagagattgaatggtgctctgttccctatgacatccccagcccctagaacagccagtaggacatataattaatgttcaataaatgttagaataaatgaacacatgaacaaaaacatgaatgagtgaatgaatgattcagtctctgccagatgtgagcgaaggaagatgagggctccgtgtgattctggagctcggacctgggcattggagtcccgatgactttggcctgcccttgagttctcacctcccagcacactgcccagcctgccttctccagctgctctcatgccttcagcctccctccatttattccctgagcccctacacccgcagtgacgtctcctcaccccacaggaaggtctctccttcctccttggcccagcttacatgcatgccacccagcacagggacaagggaggtaacaccagctctacatcagacaggccacggctgcatctgaactctaccactcgggcactgcacagcctttagccctgcgtggacaggtggttaaggcggcttctcttggtgctcatggcccttgccatccctttttctgcagcgtgggtgcaacctgcaacctgcttctaggcggtagaatgcaccaagttggtgggaggtgtgtgactgagggttatggaggtgcttatgtgatgacggtgcaggagatgtagcactgcacctattttatgggtctccctctccctggctggttttgaagagatgagctgcagtaaggaggcaggtgtgctggggaaggcagttagcgaggaacggtgcaccaactcctgaccaacagaaactgtgagatcgtagacaagcgttgttccaagctgctaaatttgtggtgatttgtttgcagcagtcaataactaatagggttacccacttttcagagctgtcctgaggacggaggtaatatacatatatacatatgcatacggacatacacgcattacattacgtatataatatacatgtagggctaggcgtcgtggctgcaatcccagcactttgggaggctgaggtgagagaatcacaggagccctggagttcaagatgagtctgggcaacacagcaaaaccccgtctctacaaaaaatacataaattagctgggtgacgcatgcctatagtcccagctactcaggaggttgagacaggaggatcacttgagcccgggagttggaggctacagtgagctatgatgacaccactgcactccagcctaggaaacagagcaaaattctgtctctaaataaataaataaataaaaatatacatgtacatacacatacacatgtactgtatatatcacgatgcttggctcagtgcttggggtgtaacaaatgtgtgttgtctccccctcccttatcttgcttttggttgccatgatgagtggtggccataactggaattcagtgggcactgaccagagatggtcaatgtcctgcaatgcatggactgtcagcacactgacaaattgtttcatccaaacggccaatgacagccccattgagaaacctattggtggttatagttagatgatgtaagctgtaaatcctcgtaattgggcacatgtacggtgcagggtctgaaaacaaacacacacgagtggacaccactgccaacctcccatgaggtgtgatgttcctccgagcctcagatgccttgggtaggtttgtgttgcgtagattctgacaaagtgagggtgcccctgacaatctattattaataaatataaattaggcttaatttcttatttattagataagaaatgtaaatcgaatttttgatattttcttcccgtgccccaaaggactatcttgtgcttcccagtttgggggccacaactttggtacagaagttattcatcatagcagttagtagagacacaattatatcatttaacaagatttctagagcggtggtccccaaccaggtatgatttgccacaccaagggatgtttgacaaagtctggagatatttttgttattgtcatgagtgaaatgtgggtgctactggcatctagtgggtagaaaccagagatactgctcaacattctacgatgaagaaaacagcttcccacaacaattatctggtccaaaatgtcaatagtgctgaggttgagaaaccttggtctaaatggaagcagtttcagggttgattcagtagctcagcaatgtatagactctgagtgcctcttttttgtttttgtttttgagacagagtctcgctctttcacccaggccagagtgcagcggcactatctcagctcactgcaagctccgcctcctgggttcacatcattctcctgcctcagcctcccgagtagctgggactacaggtgcccgtcaccgctcccggctaattttttgtatttttagtagagacggggtttcaccatgttagccaggatggtctcgttagccaggatggtcttgatctcctgaccttgtgatccacccgcctcggcctcccaaagtgctgggattacaggtgtgactgagtgcctctttgattcttttggggtttctcctcctggttgcaatatggttgtcacagctccagacatcacactcatcattccaaacaaacaaaaaaaaatctggctttctgtctccttttttctccccttctccttctccctttccctctttctctctcagagaaaaatatggcgagtgacacatgctgggtcacatattcacccctagtctaatcactgtccaagaaagactgagtggctcagattggctgggattgactgactcacctcaagggtctagattcagtacctgggaacaaaaatcaggattatatgagcaaagaagagggaatggctgttgggtagtcaacttgaccaacagtgtctgacattgagaattatttcctttttctcttcttatggtttctaccaacaaaacaaatcagatgaataaaaaaattccttgctcttccaattacttcccaccccaaaatccacctttgctgatctgactccacttcttcagcttgctggagaaaagaggaaaagtctttccactgtcccccatcagattgcattgggtgcttggtgtgctttggaacccaggtcaataggattccccttccagtgtccctttaaaaaacccaggccccctctccttcccaccagaagtctcttgctggtcctgcagacctaagctgcttatagcagcagcgaacatccaagttcactaaagaggcctgaccccagcaaggcaggtgggagttaagcaacctgagctggtccacaaatgccagacagctgtgcacatctttggggcggagacgaaaaacagatacttaacgtatctggttagaaatgaggattttctggtttggttatgcctgtcatttcgaatgtgtctcttctaatatttacagcatctatgcacctgaccttgtcagtttcaccactgagaagcaacatggtaaaccatcctcagagtatgacccagaggcttgggggtgttctctgcccagcctcaatccctcttaagcctttgtcgggggacaagtctgggtgaagatgtttatgcagataaaggtttgccaagctgcagataacccttcccatttagagaaactgctctcttgattcagccttcctctgtattcgcccccaaacctaggatatctgaccagtacccagttccataatctcaaggcgattcttatttcctttctttccctcatacctcacatctttctagcagtaaaccctgtgggttcttcattaaaaatatatcgactaggcacagtggtccatgcctgtaatcccagcactttgggaggccaaggtgagaggatcacttgaacctgggagttcaagaccagcctaggccacatagcaaaaccctgtctctacaaaaaaaaatttaaaattaactgggtggggtagcacacacctgtagtcccacctacttgggaggctgaggtgggaggatcacttgaacccagggggtcaaggctgcagtgagctatgattgccactgccctccatcctgggcaacagagcaagaccctgtctcaaaaaaataagaaaagaaagaaaagtaaaattaaaaaaataaaatatatctatctcatccacttttcagcaccttcatggccactgctcttatctaagccaccatcatttctaaattagtgcaattgcctcttcactggtcttgtttctggtcttgccaccttttcaagccactctccatacagcagccagagggatctgctaaaatagaaatcagatcagggccctaacctgcttcaaatccaccaatgatgaatcgttgtgtttaggagaaaatccgaattcctggcaatggcctctcgagccctgtactgcctggttccagggggtcttactaacctcacctcctgcctcctgcctctctctcagcccactccagtcacatgggctcccacctcctctccctaatcgctgcaaattcagtcccacctcacagctgcagaatttgccgcctcctccctcacccaggaaccctctgtcctcagaccttgtcatggcttactcctcgtcattcatatctttgctcaaatgccaccttctcaaaggcttcctgagcactcctgtcaacgtagccagcccaccctatcagccaccctggcaccatcctgttctattttcttcatttctttacttgactaccactttcctccccttatacaatgttttgtctgtgagaacaggcaccatttctaacttatatgatgctgtattctcagcacctagaatgatactcggcacatagcaggtgctcaataaattgtcctcaaattaatgaagctcattagtggccccttcacccaggagtcatcccaacctccccagcccctgggacttctgtcctctctgggttcccatcaccctgaccatccctgagccagctctgaggagaggagaacgctctgggaatgcctgcctcctcagctagacgccagactcatcaaagatggagcctgacgtagatcctgctgtctcccccacagcatgagtgctggatatgcagcagatgtagaacactgcctcagcatcaaaacacacctggcacaaaggaaggctcagctcttcactccatgtgaactcaaagacatcacagcgtctatcaaactgtgcagcatctctgacactatccttccatttctaggactttatcccatggaaatattcacttaagtgtgaggaaaagatgcatatagagggtgtttcctactgcattgtctgtcctgggggaaaattggaacctacctaaaagctaaattgtaagggaatggctacacttgccgtagtcttcccagtattgtgagatactatgtggcaatttaaaatcatcagagggctgtatgggctgactttcacgttcttggatactttgttatttattgagcacctactatgtgccaggcagtgttctaaatatttgggacttaacagggaacaaagaagacaaaaatatctgctagagtcaaggaagacaaacaaaaaacttaaagaaataacatgccagatggttgataagtgctgtggagaaaaggaaaacaggaaagggggaaagggagggtatcaggtggagatgagggtcttgggaacagtggggagcagggtttgggcttccaggggtgacggatgtcagcacgatgagcatgatgagattagtcctgctgatctccatgcagatcaagtagagaagaagggtctcactgagacctaggcggggcttacagtgcaatatggctgtcttctgctgcctcctccaagtccagcctggaagctggctcatggaagttaagctccccttcctccagcttcctgtaggttcaactagggggaagccccagcaggagacaggtgcacagtgagggctttatccccctttgctggcccctgccaggcaccgaggcttcaccgtgtctccacagaaggctctctccactctgcacccttgttggttccccaggcccactgcaccattcttacagccttcccactggctacccacagctctgtaaatattacattcattaaactccctgtattacccaggctgactgtgccatctgtttcctgagaggtcctgacacacacacagagtgtgatctcattagctagaaaaagtcaaattacccatggatatacaggcatggagactcgtttagaagcaaacatcaaactgtcaataatcactacccaagggaggtaggagaagggatgtccttgaaagacggtcttatagaaaaagagagagagagagacggaagggatggagggaacttcatttgcaccttctacttctccatgggctttgttgtatgtttggttttttataatgaatgtgtactggttttctaatttagaaagtgcagaactggaaacaaaatgccaccagccccgctggctctgcagtagcctggacagtgtatacactctctggactggcagagttggcaggtgtccttcttggggagtctgtgtggagcccagggacagctgactctggacagtgcctgggtccctcaccgtcccctccccagtgcctgatgcagaccaaactctacccaaaaagtcacctaaattgtggttggtttttttttgcaataaacatatattgcctttgttctctctacatgtatatgtagatatacacaaacacatatacaattaacattattatatatacaattaacaagtaattaacacagttgacaactttgtggttgtgtgtgtatactcctctgtaaggaagaacaggggacatagcatgtaccacagactggacactgttctcagtgctttgcacgtcttagcccaattcctttttgcaaccgctctaaagatgagccccgttactgtttgcatggataggttgagggggtggaggcatgtacacatatatgtaatgatccagcatgttaattgtgctatacaagtcccccatatcttctactcctgctggtcacttttgagcttgtcatttctcagatgcggagggcacagtgtgctgtgcacctgcagcccaggggttctgagcagcagctctggtgccgtgctgcctacgcttgagccctgggttgacatttgcgagctgtgtgcccttggggaagacactgacttatctcgatccctcagtacccccagtttacaatgggatcaataatggggaccacctttaaaactgtaaaacgtaaacagggcaatgtgtaaggtgcttagaatagtgtccagtctgcagtgtgagctacgacccccgttcttccttgctggtgggtcttgttagttgagcaatgttccccactctgagtgacagctggctagctcatcactgatctgagcctgtctttgcagtctgttgcttcactcgtacctgaaaggcacagagtgagtcactagtcaatgggtctttcagggaaagtcagatgggggagggctggaaaaacatgtgctttcctgacaaacggtttacttacaactgtcattactcttcatttcctcctgctttctttctgcctcgacatcaggtgtgatgtttggagttatagcagccgccttgcaaccatgaggcaagaagctggaaagacaagccaagagactaaaacactgtgacatcacatctgacaaaattgagccactgaaccaatgccagcagctgtgtcctccagatttcttcttatgtggggcaagacctttattatttaagccaccagtggtctgatagtgttacctgaagccaaacagactcctgtttgaaacagtgtgtttgtttcccacttatcattgaggatctgtcaatgtctccctctctctctctctttatttaatctccagggcagaatgacgagttaatcctactcctcgggtcctggcacatcatcattggtccaatctcgagagattgattaattggttgattccctttcattccctttccctactttctttcctttcccattcataggcagccattctaatgcatgtaatatattacatatttccaacttgcaggcattcatatgtgatttgcattgtcttgtgtgcacatgtatttttatcttatataaatggtattgtgccgtatatcttttgcttcttgcactctgcactgtgttcttagaatccacgcatgttgcaatgtgcgtgtctcatccattgttctaacgctgctcagagctcccagagtgcatcctccttgtggtggacttccacgtaagttctctcccctcaccaccaccactaatgctagaatgatcatcattgtacaggtcttcttatgcactctaatgataactcatctggggttgatatccagaagaggaatggcggggtcccatacttttacatgtacttaattagattcaacagtgcctgctgttctttagaatggctgcatcagactatcctcccaacagaaaatttttcatcctttttttattaccttttgcattttgagtttcccttgttaggtagactaatattcaaggctttctttcatggggttttcctgttgttaacatgcaatttctctctttgtccatttcaaagctcttcaccttgaattccatttagttgggcctcagagcctgagcgtttcccaatttttcatgcagcctttctgactcaaagctcgtgcctgctaatcctgtatgatcaagatttatgtcaatgcctgcagttcacgcatgcccactgttaagatgggataatgcctcatgatggattcttcaaaacaacagcctttgccagcaaagaaaaagagacagactgtccaagaggtaaagtgaacatctgttgtttacgtctgcccagaatccattccctcttctggccatggcaccatagtttttgtctggggtccacccctcccccacttctactctgtgaagctccgtctctccccaagtccagtcctggctgatcagagtatccacactcccagccacagcaattggttcagcagtgggcagctgacccaggccatttgataaaatgttgaactagcacattagctgtaactctttaggaagaggtgttctcttttgctaagatttctaagcttgcagagtatagcctgaaactccctgaaatgggagacagagttgagagagagagagataaagggaaagagtcaaaacttcattacatcatcattgagctactggattcagccatggctgaagcccaattacctgtttgtttcaactacgtggctcaataaaatcccctatttgaatgagacagcttgagttggatttccatcccataccgctgaacatgcagcatgcattggtgagtgagtggtagagagcttcagtgataatacagtgagtggtagagagcttcagtgataatacagtgagtggcagagagcttctcccagggcctgtgggaaaaaaaaaaagccctgtccgtcaatcatctgttaggcaactgcccacttcttcaaactcatatcttaccatgcttcccctccctgactgtgttccagccacaccagcttcctggctattctgggaacacactagcttgtcctgtgcacttgctgttgttccctctgcctagagtgtccttctgccgaactgccggattgtttccttctcatgcctcaggactcagctcaagtgttaccccctcatagggacctccttggcaagcccctctcgatgcaaccgtcagtctgctctgcagctcagcacagcagccacctgggcgatggcttcttgggcatttggtcctttacttggctgttgcttgtctcctctgccagaattaagctgttttgtcaccactgcaacccgagtgtttacgcggatgcccggttcatggaagatactccataaatatatgtgaaataaatgaaggaatgaagaggttaggaggaagagagaaaagaaaggaaggcaggaaggaagggcagaaggaagagaaggagggggagaaaggcaaaggaggaagggaggaaagtcgggggcagggaagggaggaggaggaggacggactcactcaaatgcttcaggtttaagggtcacttcttttttgttcataccctcagacttggcccaaaagcaaactcagaaacaagagtccttgaaatctcatctcaaatgtccctctggcctgctacttaattaagtgaccccataatgaaatttcttcccattgagtctgtatttaataattaattgacctcttcagcccagccaggcttggaggctcatcaattatacatctttcccatctgcactcaacactcacctcccaggaaaaaagagtccaaagaggagaggctgggagtgactggaggcgagcactggctcctctgcggggtgaagttactcccagaatggtgacctgctagggacagatggagaggaatgaaaggggctagattcaatctcgggcctgaagtttattctgaggcatcatcttgcaaaagacaaaattagtaataaaaagttaggcatgaaagtaaacatttatctagaaaagctaaataacaaccaattactttgttatggcaaaacccacaaaatcccataaaaacaacacaatatttttattaattaactaattgtctggcctgcttgaagtgtcatcaatttagtgagtatttaagactagctactcacacctataatctcagcacattgggaggccaaggtaggcggatcacctgaggtcaggagttcaagaccagcctagacaacatggtgaaaccccatctctactagaaacagaaaaattagctggttatggaggcacgtgcctgtaatcccagctacttgggaggctgaggcaagagcgaatctcttgaacccaagaggtggaagttgcagtgagccgagattacaccactgcactcgagcctgggcgacagagcaagactccatctcaaaaaaaaaaaaaaaaagatcaaaaaaaaaaactagttacttacttcacaacaaaatttgaaatggcctgaatgttttagctcctgtaggaaaaaacttgattgtcattttcccttttggccagactctttgattgtcttttctcatcaatatcattttctacagagagcagagagaaaagaaaggtaactcattcttttctttagaaagttgatcagaaaaaaaaaagaaagaaaaaaaaggaaaagaaaagtctgaccatttagaagtttcttttggctttgtaacctgtcagggctgtcactacgaagtaacacagcctgtgtgccttaagaaataggaatttattttcttacagtgctggaggctggaggcctatgatcaaggtgctggcagagttggtttcttctgaggccccctccttggtctgtagatggccgtctcctcttcacacagccttccctctgtgcatttctgtgtcctgatttcctcttcttaaggacaccggtcatattggattagggcccaccaatatgacctgatttacacttaatctttaaagaccctccctatctccaaatacagtcacattctaagacactagggttaggacttcaacatataaatttgggggaggaacacataattcagctgacagcacacacatttacagggcagttgtcaaatttggggaaaccactatcaagtttctttcctacatgagctaaaacattttaaggcatttcaagtcttctaagcacagcaactaacctaaaatacctgatgcgttggtaactcttctcaaccagtttgtcaatgacatctctgtgctgtgatgcttcatcgggatcagagcgggcaggtggcattttctagaattccattctcacacttgaaggacagcaatgatttacccatagagacaactgcaagccacatacaatatgtcgtggtagccaaagtgaatgcaatcccaaccaaaccccgctttgaccagaccccaacagcgcccgcggccaccccagcaccactccgtgcaagggaaagtgcagggaaagtcaaaagacaaaattagtaataaaaagttaggctgggaaagtcaaaagacaaaattcattttattcagctgtgactccgtagtgcccattgccatctaacatagtacatattggtttgtttttgttagcagaaagaaacagtggtcttaatgggctgccattcaaatatcttgcttttacaaatttcacaaacatgtgccttgatttttacaaatttcacaaacatgtgaacatagcgttagggcccttcccagggctttggaatgtccctgggcaggtgatgggccctgaagcttaaactttataaacttcccagtaaatctgcctccaagtgggtccagattgtgagcttcctctcctgcaaccccatgcaacccctggccaggccagagttccaaaaagagagagaacaaacagagcttttttggtgttgtgtttcttaaggccactgcccacctgaactgcggcaattaaccacagagttgaagggttaaaacaacagaaacgtgttctctcacagttctggtggccagaactccaaaatcaaggtttcagcagggccacgccctctaaagtttctacaggaggctcctttctggcctcttccagctgctgggagctcctagtgttccttggctgtgaccacatcactcccatctctgcctccatctgcacgtggccttctctccgtgtctctgtgcgtcttcttcttgttctcttttaaggaggctggtcattggatttagggcccacactaatccaggatgatctcatcttgagacccttaccttaattatgtctgcaaagacccttattccaattacggtcacattcacaggtaccagggttaggacctggacatatcttttggggaagacactatttaactcaccacaggggggttaaccatgttctcatctttcatgaccattaaggagagcaggcctaggcctcagtggtttaataaaggaaagaccacccttcatgcctaaaaatcccaccattatgactccccttaaggctgcttttatccatcacctgcaggctctggaagcaaatgctctgcagacaggtttttctcccacccaggagttgcccagacttcaacctatttctcaacttcatggtgattttcatatccacaaaccacttcattaatgttttaccatccacttaatgttctccttccaatagatttatttttaaaaattcagcctcatcctaagcagtaatgcccttgaaattggggcattgatgtgtcacttctattttttcctatacatacttgaacaactggagtttgcatgtattgatctctgcctttgtgtcatagctaagtcctggtgatttcatcctcacgtcaaccctgcaaggaaggaactgttactaccacccccattttacagttgagaaaatgtaggtagagaaagggtcagtaacttgagccaggtaagaagggacaaaatggagagccctgggggaagggacagaggaaggagaaaacagactgcaggctggttcttggtgtgtaagggtggatggggaagcaggagggagagaacagggggaggagaagggaacagggcaaggagagaagggaagcggagtttcaagggatgaaataaatcctgagcccagaagtggagaaaggtcaccaggtcctcactttgcagaagtcttgactttgccaggcactgtattccatccataacaatgagacagaggtctgtcctgtagatcagagctccactccatcgttcaacatagagattcaagatgaagatgaagggattttattgagggcagtgggggtcacagccaccccccattgccctgggaaagaactcctttagaggctcgtcctttagcccctccccatcaatgctgacacagccgaggttgccgctggctgcccacctgaaattcccctatcaccaacttagcttctccctgcccccatccaaatttcccctgtgggtccctcgggctcaataagatgctacaggttggcccagaaactgagtggagctggagcgttcctcactcacccctttcatcacagctgctgtgaactgagtgccaggctctgcgctaggccctggggatatgacaatgaacaagccaaagtcctagcctcccagaggtgacattccctggaaagtattaggatgagccagctgctgccaccaacaagccttgaatctcagctgtttaattttaaaaggaagaaaaagtttatttctcattcacatcacagcccactgcaggttggcaggtaagggcccgagggaccctacgagttcttccattcaatggctctgccgtcgtgagcctggcattcttaacccattgcgtgcttctggacctctttgtgtgatagtattttaaaatccttcaattgtcattaaaaaataaaacacctaggactatgaagaataccaattatattgaaacataattatccagtatttttctcaattcatcacttagtaatatgaattcttctttttaacacattaaataacaagacctagtggcagatctgataattactgtaatttcaaagtagtaatgagtgtaaatctatggtcagcaaactactacagatgggccaaattgggtaaacatgccacctgtttttttcaagttttattggcacacaaccatagtcatttatttgtataatgtctgtggctgtgtttgttctacaacagcagaatcaaatcgttccaacagaaactgtatggcctaaaatatttactatctgtgtctttacaggaaaagtttgcagttaacagtatttttgagacatttgcagcaactgtcatgtaatatgaaggcatttatggtttctagggaaaaagtcacaggccttgctgccaccattgtggcttgttggctacattcattattgaagaaaatgataattttcaattcaaggtgagtaaaaataaagacacaatattttaaagatccaaattcagagattccccctctgccttttagccacagatctctgtaggggggtctcaggactgatcccaggttagaaagcccaggttaaaaaaccctaatctggccgggtgcggtggctcacacctgtaatcccagccttttgggaggctgagccaggcggatcacctgaattcaggagtttgagaccagcctggccagcagggtgaaaccccgtctctactaaaaatacaaaaattagccaggtgtggtggcgcacgcttatagtcccagctactcgggaggctgaggcaggggaatcgcttgaagctgggagacagaggttgcagtgagccaagatcacaccagtgcactccagcctgggtaacagagcaagactgtcaaaaaacaaacaaaaaaacaacaacaaaaaaacaccaacaaaaaaaacacctaatccagggcctcaggggctctctcccagatcctctgcacccacaggtgacaagggaggagagcaagtatggaggatcctgcaggaggttttgtagcccaagacaaaaggtggcgtccatcacttctaccattttcagaactcgatgacagggtcacgcccagtttcaagggatgctggaaaatgcagttaagcggtgtacttaacacaaatatttcgtagagctaacaaaaacaaaccaatatgtactatgttagatgggaatgggcactatggagtcaaagctgaataaaatgaatagctaattccagcatgaaccatgattttaaatagcatggcaaggaaaggcacccctgagaaggcaacattgaacaatgatctgaagattccaagcctggggctttctggggaatgatgttgctggcagcaggaatagcgtgtgggaagggcccgagggaaaaatgcaactatgatgattttgaaggcctgagattcagtcacagtatatattttaatcgtttgtctgtttcttgtctgtctcccccactagaacgccagcccatgaagaagaaatttttgtctattttgttcactgctctttcctaagagcctagaggcgtgtctggtacatagttcgcacctgtttgtcaaatgctgccggaacatggcacgatctgcctgctctagggagacaggagtatggaatgagggcagagaagtctccctccagggagatcgcttagggccataggccatggtggggatcaacattttattctttaggaataggaaattatcggagagtcttcaccaccgagggatgagctccaattttgattttgcaaagatcactctggctgctacagtggatgctgcggcaggtgaaggcttggcaaagtgtctgacactaagaaggggagttcagtccaacagcctctggggcagtgagtgagaaggtgttttgagaggcgaagtatgggacctggaggaccccttatcctggagtttcactgctgagaaaggcctcaaattgggcctttggaaattacatctcaatgagctctcttctcagtctcaaggactgaggagcttctgagacacagtaggttcaccatgtacagagaggagactgatggcaccccctgcagccacacactctttcggcagggctctaggcagctctaattgcacgaacttgtcctataaacatcttaggcaaaagcacaattttattgcgccttgatttttttttttcttaggtggagagttgttgagaggtcgatgcagtccacgtaaacatgtaaaacagcctaacatttcaaaaccctgctattttttgttaggttggtgcaaaagtaattgcgagttttgccatgaaaagtaatggcaaaaaccgcatattacttttgcaccaacccgatatgtccgtaaccggagcaacggaaaacaaacaaaaaaaagaggtggaaagactggctccccacaactgagagcctcgtggggacagccctggactgggagtcactggtggagctgcctctagctgggtgttcctgggtgcggggctggtcttccctggccaccgtcttctccaatgagagcgatgacaggatctaaggggccccctggcgctctaaggtcctggccagtggagaccctggggtgcgacaaaggggttagggggctcccccctccccgcccctcgcccccacctttccccctcgcgctgtctctccaaccccatccaagccccaggctggaaagccccagggaggccgccacagtaatgacccctcgacagctgcgctccccgcgaagcagccgcccccaccccccgggcccccgccctccgccccgccgcctcggcagacaggttcgcacctgctcggggccatttctcatcaattaggccttggcagcgcttgaatggggcccagctagggtgcgtcccggctcctccccgcgccgccccctgtctccccccaccagagccgcgctcgcagatggcagctcgggcgcagctgcccgccgggctcgcgggggccacaatcggcccagtgttcgcagcccccaggttggacagggggccgggcacacctgcgcggcgcagatggcgccggggggcggacagcaggcaccaaagtctcctccggggactgggaggcgggaagagagcagggccccctcaccgcaaggcggttcctgtcggaactaggaacctgtagggaagaggccatcgagaaaatgaccaggggcagcgggacccagccatgccctagtccttctcgtttcgaaaggagggagtcttttttggatagtagcttggtaacctaaatgcccagcgataggggattgactagaaaacgtgtgctgcgattctgcagggcacggactcaaccattaaaaatatactaaagaaaagcaagtcgggaagagggatgtgttgagtgtaacttttggttgttgttgttgttgttaggtagggtctccctctgtcacccaggctggagtgcagtggcgcaatcacagctcactgcagcctctacctcccaggctcaagtgatcctcccacctcagcctcccaagtagctgggttttttatttttgtaggcgcaggttctctctatgttgcccaggctggtcttgaactcctggactcaagcaatcctcctgtctgggcctcccaaagtgctgggattacagctatgagccactgccgcacatccagtgtaatcttaatttggggaatctgagtttgagctctggtgtcatctcttttgagcttgatcaggtcactttacccttgccaacatcagttttctcatctgtagaatggtgtaataagagagctgttgcaggagttaaatgagacaatgtgtgaaactgcctagcctaggtgctggcaaacagcaaacacctgtagtaagtattttttattatttcttattatacaagtaatacatactattcactgttaagaatccacattttatccaattatgtaagattaaaagctaaactactctataatttcacctctacctgagatcaccattgataacagttttgtgtcttgccccatgatttttttttctttttctcttttttttttttttttttttttttttgagacagagtctcactctgtcgcccaggctggagtgcagtggcacaatctcggctcactgcaacctccacctcctgggttcaagcggttctcctgcctcagcctcctgagtagctgagattacaggctcctgccaccacgcctggctaatttttatatttttagtagaatgttggccagggtggtctcgaactcctggctgcaagtgatccactcgcctcggcctcccaaagtgctgagattacaggtgtgagccaccgcacctggctgccccatgattttttctacactatatgtataataaataaatacagatagatctatgcgtaaatatagattccagaatcaaatagaagaagtttcacttagaggctgaaaccttggagtctggagctagacttcctgcactaaaaaacctggctcttgtttccctgctgtgtgtccctgggaaaactacttaacttctctggaccccagtttcctcatctatagccttgtaggaaagttgtgagattaatacaaaacatttccaacagtgcaaatagaaatatgagcttcattataggtgtggttttgtaactttcttccttaatatgtcttagatgtttttatgtgttggaaaatttgaaataatattctttttaacggctgtagaatatgccaccgtatggctccatgtaagcagccgtcttctaagaaggactggactggtttcccatgctgcggtgagcactcttgaacacactcttttgtgtgacagttcccctaacgtcaagcctgaggggtggtatctgctggataaggccccttatggtctggcacaagcaggatcagaagtagggtgaggtgagtgaagcattcaggcacaaaatttaagaggatgccccaaaaactcagtaatcaagataaattgtatcttaatgcaatatttttaaaaatcaaaattaatgctaaaaaccatccataatgagcaaaatatcaacgttttaaagacagcatctgacagtgtcatactggctttgttgagcctgtggccaaaggaaaaacgtgccttcatatacatattttaatgtattctttaatggtaattttctcccaaatcgttgaagtagttgaaaaatatacactgaaaagttagaagtaagtgtattaaaactcacagcattacttatgttttattttatttataccccaaacagaatttgtatcaattttactttgctgggtttaatggaagcaaactcatcgctaatattttcaaaatctactcctggaaagaatttaactgtgaaaaaatagattatttatatgtatgaggctagccgggcatggttgcgaatgtctgtagttccagctactcaggaggctgaggcaggaggatcgcttgagcctgggagctcgaggcttcagtgagctaagatcgagccactgaactccagcctaggtgacacagtgagatcctgtctcaatgataataataataataataataataataaggctgggtgcagtggctcatgcctgtaatcctagaactttgggaggccaaggtgggggcggatcatgaagtcaggagttcaggaccagcctgaccaacatggtgaaaccccgtctctactaaaaaaaaaaaaaaaaaaaaaaaaaaattagccgggcgtggtggcaagtggctataatcacagctactcaggaggcggaggcaggagaatcacttgaactcgggtggcagaggttgcagtgagctgagatcgcgccactgcactccaacctgggtgacagagtgagactccgtctcaaataataataataatattaataattttttaaagtcatatatatgaaggctgcacattttccctttggcctcaggcttcaaaatgactcaacaaggtgctggtatcgttaatttgcctttgcagagggtggcaccaattgatgcttccactgacagcaggctccattttttcaagcaccttttgggattaagctgctcagcagagggtcattatccccacatttgggccttcatctgggaggagccaggagctggtatgcctacctgggctggctttctgtcctccctttcttgtgagagcttcccagatgcctctgccaagcctgggcagctcaggttactgcagactctaagagctgccttatctcagatctgcaaagccccagcacttcattctcaggaaaaccttttaactctggggtagacaaactctaaaaactctagagctgccttggggcaatgacagcagctcctcgatggactagatctgggacccctgcagaaataatctcatgaatgttcccttacctgtggccagcaagacctgctccattccttcctttatttacatcctcagtggctaccctgagtcactgctctgatcagccctgagtcaaagcctgggaccgaggcgagttagtcatggtctctggagctcaaaggggcagacagacgggtaaacaaagagtttccaagactctttcatgtctgttattatctcaccacattgtccccagagacttgggagcacttgggccagatataattggatgtcaataggcatctcaatcttaacatgtctaaagcagtaatactaataacaaaaccactagtaataataataatagtgtttactgcacaaggcactgttataagtgctttacatattgtaactcactcagtcctcatcacgaccctctgaagtacagcttttagtttcattttacagataaagaaatcgaggcattaagggactcagtggcttgcctaagttcctgcagatgttaaatggcagtgctgggacatgtacccaagggtctggctccagagtccgtgctcttaacaatgaccctctgatcttcagttccttcccatttcccctatatcttccacatctcacaaagtggcatcgcacaaaaaaataaataaataaaaacatctatgcaccatttttattccactcttacccaattcttttcatacctgacttctcgtcatcactcaaatatcagagatgtctcaaatttcagttttcctgaaagcaatcactgagaaagggattcaagggtacgtagcttatttaagagatgagaggtgacggttcaaggagaagcattgaagaagacagaggagaaaagtcagcagatacagtgtgccttatcaagtcagccaccacaacaggtgaccacagacagcttcatccctccaacaaactctgggaaagagtgcaaagcacacagctcagaattattccgtctacacttcgagggagctgggatattgatacgctaactcctgagagtcattggttgagatgtactggggaggagtgtgcagtgttaaatcgtgggcacttcttccagccagcagcaagtccttccagtttcagggaaaaaaacccaggtaaagatgcagatactggcaattaaaagtcactagagcatctagggaccatttgctatccctcacctactcctcctcatctctttcttcttgtacgtaagacgcagaagaaaaggaaagcaatacagagtatatcaccaagcaggttttcagcgtgagcaaatagagcttaatctcactggggtgcttggggaggcagcacaaaatatgtgcctcagagtgatcccacctgtggggagagggagtggaggtatttatcctccaccctcgaattgattggttgagggctgcttctggggtattaacccaacagcacttctggcttgctctgaacatgggccaagcatgctcccagggccagaaaaagtgcctcaggtggagaagtgcaggtgtttgcagtaagcgtttttggtgagaggaagacagtacaagaggatggagaaggagcagcaccagtggctgcttcaaatagcttactcatccgaaggagaaccagatgacagtgaccatttagtaagcacctactgtttgcctggcttcacgctgagtgatttccttatataagttcactgcaaaacttgcttttatatcattacctttaaaaaaaaaaaaagaaggcaaagtttagagaaagtaggactttacctaaagccacatatccagataacatggtggactcaggattataaccagatctgtctgacctgaaagacccaatatttttttgcctcatgctatttctctggatttctctgcatctctgagattcacgattcccaccaatctggcctatcgggtaatatgtaccaaggctattatgagcactgaagtgaataaaatgctaatcctcatcgatagattaaacagagaaatgcttaaaccagagatctgcctgcaataaaagcaattgggttacttctttgtaatttgactgctcacatgagcccaggaacctgcgttatagctttacaaatctgtgataatttccttcaacttttccattttattaccgccattaaaatcccgttgtgttctttaaacaggaaaaaaaatgattaaaacagatgtggctcttaaagttacaatatgaattttacaaccccaggttttatgatactgagagaaacttcagccaccagggtcagaggcaagaaaaatgggaccggatttctgaaatgggtctggggagggggaaaggagtagggtgagaggttcagaatgacgaagacagccaacagagccaatttcctgacatttacttttctccccaaactctggggatcaactgcagaatgtcacatttgcagccatccctctgcaccacagagcctggtccccacagctactgaggtttgactcaactgctttccctccctccaacctcacttccaacccacgcccacacccccaccaaatcataattttccagttaagtagtccacagtgatcattgttttgttttttgaagcagtgttttatagtaaagagagcattgagatccaagtcccagatcttcaactaattcaccacgtgacttgggcaaatcagtggactctgggcttccagtttttcatctgcaaaactaaggagttgtaccagatctctctgttctctcttagcactgccagtctatgaccccatctgcaggaacacaatgccaggcacaaaggaagctctgaatatttgttgccagaagaaagaaatgatttcctaaatttgtctgtatttttcttttgcagggaatgaaggggttattaacttctacaaataaccgaaaaaaagaaggaaagcaaccataaagtttgtttccttttttatgtaaaaacagtaatggtgagaatgacaaaaattttaaagagcccatacacagtgttggcaaaaatgtgcagaaataggaagtcttctatactgctggtgggaaggtaaaagagtacaatatttctggagggtgactatcaaaatgttaaaagggcatgtcctttgaatctgcaatgtcactctcaggaaatcatcctaaggaaataatcagaaagatatatttagagcacaaaaaatataatataaagtccaagggaaggagagaaaaaatataaaaatttatatactgcattattgtaattttaagtttttttaaaaaaataactgcatagaaaataactgaaaagaaaacatcaaaatgttacatagaagtggccgggcgtggtggctcatgcctgtaatcccaaaactttgagaggccgaggcaggtggattacctgaggtcaggagtttgagaccagcctggccaacatgatgaaaccccatctctactaaaaatacaaaaattagccaggcatggtggtgggcgcctgtaatcccagctactcgggaggctgaggcagagaatcatttgaacccccgaggcagaggttgcattcattgaaccgagatcacgcctgcactccagcctgagtgacagagcaagactctgtctcaaaaaaaaaaaaaaaaaaaaatctctggttagtaagactatggactattttcttctttaggtatttgaacactgctctcactccctgtcttccttcaggtctctgctccaatgtcaccctgtcatcaaggttttccttgaccagcttatctaaaagagcaaactcctgctccttctctcccattgccctctttttcttacccacttttattattcttcactgctggacatagtatttataaatatttagttatatattaaattgtgcctcacaacacgaatggcaatccgatgggggctgtcttcccctcacctggtatataacagtcacaaaattgaatgataatttgaatgaatagatgacacatgcaaagatatatgggcaaagataatctattgtgctattgtttataaaagtaaaaatttgcaaatcaattaaatgtctaacagtagaaaattggctaaatgcaatatactacatttacacattggaagtttatgcaacacttatttcaagtttgtttttaacatatgtatgtgtgtaagcgtgtctgtacatataattgtatttttcttcctagcaataaaagaaatccacgttgtttgaaacaaatcaatcaacagagattagttaaaacaacaattcacacctgaagctttaatagttgggtcagaatcttcccatacgctttttttcctccatgcttgtacaaataaatgccaacaaatagtcacataaataagtttctcaccctttccaaaatctgattaatcatatacattgtagacatatattgatctaattcaaactacaacagagaagtcatgatatgaatacaatataatttctcaaattgttacgctatgtccatcacgacattcagatggtcctaaatttttgtctatataataaatgctgcaataagtatccttggtcatatatcccatattgatctttttgtttatgtaggatggatttccaaatgtgagacttctgggtcaaaggttccaagcgttttgtgtattcatttatttatttatttatccttgaggcaaagtctcactctgtcgtccaggctggagtgcgggcagatcacttgaggtcaggagtttgagaccagcatggccagtatggtgaaactccttctcagttgggcatggtggctcacgcctgtaatcccagcactttaggaggcagaggcgggtagataatgaggtcaggagtttgagaccagcctgaccaacatggtgaaaccccgtctctactaaaaatacaaaaattagccaggcatggtggtatgtgcctgtaatctcagctactcaggaggctgaggcaggagaatggcatgaacccaggaggcagaggttgcagtgagccgagattgtgccactgcactccagcctgggcaacagagcgagactctgtctcaaaaaaaaaaaagaaagaaagaaagaaagaaaaagaaactctgtcactactaaaaatacaaaaattagtcaagcgttttaaatttaataacactttcacaacacttttaatttaacaatactttttaacaatacatcaagaatcattgtagcaattcacatttcatcaggaatgtatgacagttccttcccatcttcaccaacccggggtattgccaatcttcccaatttttatcaataaaggagtacaaaatactctattaccatctagatttttttgaccatgagcaaggttacaaatattttcatgcgtatacgtcgttctgtgaacacactttgtccattttgctatttaaatgtttatctttttcttgtcaatttctaggagctctctgtagattagggacattatatctttgcctatcatttttttgttccaaatccccccccaaggtgactctgagtacatataaatattctctgaagcattattcaaaggttatagttgtattccttcatttagatattgatccatctagaattattttggtatatacaatagcatgaggtagagtttaacctaccttcttattaatgataccatttgttaatgaagcagtctgtttctgttgaatttaaacgccacctatatatattaaaaatatatatacatacataaatttatacatataaatatgtatacataaatttcccaaatatactcagattaatttatggagtacctataatgtcctattaatctatttgttcttctgtccttttctttgaactaactttctagtaactcctcagctagggtcctagcaggaagcaaaccgtctactcaagtggtacaacaaagaagggatgggcaagctttatggaagcaaacaaggagtagggcagtacaccagggccagtgacagggggagctgtccctagggtgtgctgaaggtggctcacactagctggcaggagccagttgttagcaacacgcaacttcacgttagtagcttgaaatcagccatggtgggaatacttacaccaaggaaatgggcaaatgctgtacatcagaggttcatgcccccctttttttcagagcttgccattcagcagttactagcacacctctgggaggaagcgttttctggaatctggggagcagagttctatggagagggctgtctgccagggactgtggtcttcagtaggaaacaggcaattcattgtaaccccccagggaaggagctggggaggaaacattctgacttgatcttctgcccccctattccttacagtacctcccactgcccaaatccaaccaggtataagaggacgagagagctggggacgcagtcacaggggccagctttggggcagggtagagaagggcagagacagatagaaacgtccagcccaagatcattttccaccccacccaagtcttcattttaaaaaatttcttcgtgatttttatccacatccagaaaaaaacctcactgaggtaaggattggaattttatacaattgaaaaattaatttgggaaagatcgaaattttatgaaactcaaaatttcacaaatttcaaacgatataaaattttaaaaatctaatgtctttttcaaatttgaaatttgaaagtacatgtctttccacatattccttttatttaggcttttgttttttattctctaattaaatcttacaatcatttccatatgggtcttgtaattttcttgttaaattcctttgtattttatagttttgatcactgttataaatgaaatatttttctgtgttcatgcctaactgactagtcctaataaaaagaaagttactggtgtcttcatatttagtacatattcaagcaatctataaattgccatttacaaagatcaaaaactcatgtgaatactattttgtaagtaggttcttttgaattttctatgtttacaattatatcatctgcaaaaaagaataattttgaatatttatactacttattttatttccttatataatcgtattagctacaaactttgaaaggacagtgtagacgatagccatcctgtcttatttcttattttattgggcctgattcatgtttcacagtaaaatactaggttggtgcaaaagtaattgtgatcttttccattaaaagtaatgacaagaactgcaattacttttgcaccaatctaatagtatgtctacggttagcttgtactacatatttttattttattcatgtaccttctttctagaaacagctgtagaattttatcaaacgctgctccagcatttttcaaatataaaatctggcttttctcacttactttgctgacgtaatgaattctgccagctttttaaatgatgagccattcttgcctccctgaaacacatgttatttgctcataatatattattcttttaatatgccgctgaattatattcgctgacactttattgagatttttagcatctttattcataagtgaacatgatctttattcataagtgaacaattagttttcctaattgtattaggaatgacaaaccttagcattaaggttgttctttgttttggataaatgatttgaggaactttgcatcaagttttgtagactgaagcactttaaataatattttggtaaattttgtttgtcagtttgtttgttgttattgttttgttttggagacagagccttgctctgctgcccaggctggagttcagtgatgtgagcataattcatggcagcctaaaactcccgagctcaagcaatccttcccgctcagcctcccaagtagctaggactacaggcacacatctgtgcccagtttatttattttggttgtttgttttatggagacagagcccccttatattgctcaggctggtctcaaactcctggcctcaaacaatcctcctgcctcggcctcccaaagtgctgggattataggcacgagccatcatgcccagcccatcttggtaaacgtttaataatgtttcgctccttcttctggttagctgtctttttctatttctcacctcttcttgagtcaattttgaccgtttatgttttgcttaaagatcgcttatattccctacattttccatggtttgctttgaagttccgcaacttttttcttataattatgttactcctttctatatttgtaattatatatcctctctcatactgacgcacatgatttcctttatttttcctcacaagggatttatctaggtcattttccccctgcaaagaaccgactttggttttttactcccagcgtttggctttttgcttcccgtatggcaagttaggaagggaatttggagtcaaatgtcagttctgctgctcaccagccagggacatcggcaaatcatttactgaccttggtgagcctccagttcttatctgtgaataagaacatgcctcactcccagggtagtgatgtagtaaaaaataagaaaaagcctataaagcacccagcacaactcctgacacacattaagacctcagtggtgttagtggtattactcagggctctccagaggaacagaaccaataggagttataaatataggctcatgtgattataaagcctggcaagtccccagatctgcaaattgagttacaagctgcaggcccaagaggagagagccaatggtgtagttccagtccaaaggccggcaggctcatgatccaggaggagccgacacttcagttcaagtccaaaggcaggaaaaagccaatgtccaagttcaaacgcagtcaggcgtgaggaattctctcttatttcagagagagtcagccttttttattctattgagaccctccactgattggatggggcctacccacattagggagggccatctgctttgctcagtctacagatttaaatgtaacttcattcaaaacttcctcacagaaacacccagaataatgtttgatcaaatatctaggcacccctggcccagtcaagttggcacgtaaaatgagccattacaatattcaccacacacgtcacccagcccagactctttgcccccacaggcacatgtgcctctctacctgagcatcgcacatgctttatttattttatttgtattcaatttgtcttatgttattatatttgctagtttgttgttagtcttctcccctataaatgccctagtggaagcacatggcttgggataagaaactgagagatggcccaaaactcctccagctgatgaacaacttcagcaaagttgaaggatacaaaataaatgtacaaaaatcactagcattcttatacaccaacaacagctaaactgagagccaaatcaggagggcaatcccattcacaaaagccacaaaaagaataaaatacttgtgaatacagctaaccaggaaggtgagagagctctataataagaaggataaaacactactcaaagaaattaaagaagacatatagatgcatagatggaaaaacatctatgttcatggataggaagaatcaatatcattaaaatggctatactgccgaaagtgatttacagattcagtgctattcctatcaaactaccaatgacattcttcacagaactagaaaaaactattttaaaattcatatggaaccaaaaaagagcctgaatagccaaggcaatcctaagcaaaaagaacaaaactggaggcatcatgtgatttcaaactatactacagggctacagtaaataaaacagcatggcactggtacaaaaacagatacatagaccaatggaacagaatagagtccagaaataaggcttcacaaagctggtaaaaacaaacaatgtggagaagactccctattcaataaatggtgctgggtaactggctagccatatacagaagattgaagctggaccccttctttacaccacacgcaaaaatcaactcaagatggattaaagacttaaatgtaaaacccaaaactataaaaaaccctggaagaaaccaaggcaataccatcctggacataggaatgggtgaagatttcataacaaagataccaaaagcaatcacaacaaaagcaaaaattgacaggtgggatctaattaaacttaagagcctctgcatagcaaagaaattatcaacaggataaacagacaacctacagaatgagagaaaatatttgcaaattatgcatctgacaaagttctaatatacagcatctacaaggaacttaaatttacaagagaaaaacaaacaaccccattaaaaagtgggcaaaggacatgaacagacatttctcaaaagaagacatacaggtggccgacaagcatatgaaaaaaagctcaacatctctgatcattagaaaaatgcaaatcaaaactacaatgagataccatctcacaccagtcagaatggctattattaaaaaagcaaaaaataacagacactggcgagtttgcagagaaaagggaacacttgtacactgttggtaggagtgtaaattagttcaacccttgtgtaaaacagtatggcaattcctcaaagagctaaaagtagaactaccattcaatccagcaatcccactattgggtatatacccagaggaatataaagcattctaccataaagacacagcacgtgaatgttcattgcagcactgttcacaatagtgaagacatgaaatcaacctaaatgctcatcaatgacagactggataaaggaaatgtggtacagatatgccatgaaatactctgcagccataaaaaataacaagattgtatctttggtggaaatatagatggtgctggaggctattatccttagcaaactaatgcaggaacagaaaaccaaataccacatgttctcactcataagtgggagctaaatggtaagaaattatgcacacagagaaggaaacaacagacactgggatctacttggggggggaagatgggaggagggacaggagcagaaaagaaactattgggtactgggcttaataccttggtgttgaaataatatgtacaacaaacccccgtgacatgtgttcacctatgtgacaagcacatgtacccccgaacataaaagttaaaaaaaagaaactgggagaagaattttaaatttatatgtaactcatacacatccatgagcccctgtatttaacaatcaatgtttcatttaaagaagcataacccaagcagacatatcaatcttccctcataactctaacaaatatcagatgtgggcaggcagtatttagccattgataacacttattatcaatttcttgtattcttctatacttcagcaccctgaaactctacctctcagttactttgtgctgttcctattaccggcgtatgtgcccctcctccactttgataaatcactcaagcagcactgtcttttctcctctttggaaagcagaagaacaaacaggagggtatattttccacctcttgatgacagtatccctcagagtaaaactaacagaggatagcagagccatgagattctgtgggcctgaaccctgcccagacgccctcctactctggctctaaggctgagcatgtgactcaggcaggtccaatcagcatagtttattcccctggccccagggagcatttcagggatggacacatgactcagccaatgcaatgagactcaatgcttggaatttgtctggatttattagggaaagaaaagctctctttccactggaggggttaggccggcaggaaataagtctggagctaccagaagcatcttcccaccacaagcctacctgagaataaagtcaatgcagaggtaaacagatcagagagatagagtgagagcaagtccttaggattaagcacctagatccagccaggcctgaagcccttacctctggatttatctgttgtatgaaccactacatatccgttttagttgagtttctatcacttataactcacagggacccaagtaactctgaagagtaacctatgaattcattgatagttgattttttgacccagagatcccctctctgtttccatagcctccaatgtttccattaccaggtccctaatcctggtatacagaaattatctcttctcttgtctgtcttctcccaaatactgcagctacttgaggccagaaacctggctttttcatttctgtgtcctctaagtctagtctagaatccagaacatacagttcctgggatcctacaatgtggtaagtcccttcttaacattaatgcttcccgcccccttaggtattggggatggtaggtattgccatcctcaagttacaggttgggaaactgaggcacatagtaaacatttcttaggaacttaataggtgacagactcctgatttgaacccaggcctctctgactttaaagcagcatttgataaacacttgttgaataaatgaataaccccacaggctgactttgacattcatcctaatgaaactttagctttagttctttcccacagatcttgacgttggggagccttcagaatttttccagaatgtactgcacgcagaacctggaacgtcttgggtagctggtccaaagctgaccaggggcctccttctcattttttcttccaggacttcaatctgcagccccatggcctgctgttctgaatagccgccccctgccctaaactctgggatgccttcctaaagcagctctcaagttttactgtgttttgggaggtcttcttcccgaatcctcagagtcttaatgctacattccccccatcaaggtcccagaagacctcagcctcttttctctgtccccactcttaacactcccctgtcccgagtcccatgctctcagctcctgttggacgtcttcctccttcaagttcctcaggacacactgaacctgcttcaatccccacctcagggtacatggcctctcacgccaaagtctgcacatgtcctgtcatccacccaaagctctcctcctcaccccaaagcccttgacccttgtaacccctactcatcatgcagacagctggccaaatacatctccacggggaattccctgggtaccccccacccggtacaccagaatcctccgttttgtctgctcttactgttctgtacttctctttaatatcccccaacacacctgtaatgacccaccttttgagtgcctgaacacctctagactgtgcacaccacgaggacaaagacatgtcgtgctggtttccagccatatcctcaccgtgccctgaacaagcctgacacacagtggaactccataaatacttactgacctactgaatgaataacataaactaatctgtgctcatatttggaggattctgatgggttgatgatcagcccctctcagattacaaattcatttgcacttctctgagcagagcccacacttcctgtttgtccaaaaatccctacgtaaccttggttctttctccactgaaaatctcatcctctccatgcctttaaaagaataataaggataataaaagcaaagataataacacatgcctgtgactgccaagcagtgtgctaagcacttagcacatttcagcccatgcaatgttcccataaaccctagaaagtgggctacggtcgttgtctccattttacagacaaggagactgaggctcagaaagattaagtcagttattcaaggacacacagccagtaagcaatggagccagacagtctaaccccagaaaaacctcatataaccactaaactatataataataacttcccaacattttttactgtgactcatagtaaaaaatactttttatatcatgacacagttcacacatatgcactcacccacaaaagactgaaacaaaagtttcatgaagcaatacttagttttattatgtgctatgcattctatttccttaaaaataaatgatggtcatgatccaaggcagttaataggctatacattccagtaggttaaaattaggtatgtaccacatttgagtttacagtactgctttttattagggtttaaatgaaaatacttatttgtatgtacagattatctgctgatgcgatgcaggcagagttaacagccccctaaagatatccgtgtcctgatccctggagcctttgaaaatgttaggttttatggcaaggaggaattaaggttgcagatggaattaaggttggtaatcagttgacctgcagatcaggagattatcctgggttatgtaggttgggctcagtgtaatcacaagggtaactggaaggatatatggaaaacggaggtagaagagaatgtcagagggaggcaacgtgaagaagactcagttggccagggctggctttgaagatggaagcaggttatgaggaggaacacaggtggactctagagactgggaaagagaaggaaatgggtccttcaccgggcttccacaaaggagcacagctccgatgacaccttgattttagtcggtgagacccaagtcagacgtctaacctacagaactgaaaaataatagtccgggtgcggtggctcgtgcctgtaatcctagcactttgggaggctgaggcgggtggattacctgaggtcaggagtttgagaccagcctggccaacatggcgaaaccccgtctctactaaaaatacaaaaattaactgggcatggtggcaggtgcctgtaatcccagctacttgggaggctgagacaggagaatcacttgaacccaggcagtggaggttgcagtgagccgagatgctgccactgcagtccagcctgggcaaaagagcaagactcgtctcaaaaaaaaaaaaaagaaaaagaaaaagaaatgtgggttgttttaagctactaaatttgtggcagtttgttacagcaacaacaggaaaataacagattcccaagaaactggtaacaatattgtctctggggagggggaatagttacttagttgagggatggagtaggatgatagagagtaaaaagagcctactgtttgaattttgaaccacttgaatgtattatttttagcataaataaaatgctttgaatatttggggcttcctttttttttttttagacgaaatctcactctgtcgcccaggctggagtgcagtggtgccatctcagctcactgcaacctccacctgctgggttcaagcaattctcctgcctcagcctcccgagtagctgggactgcaggcatgcaccaccatgccctgataatttttgtatttttattagagacagggtctcaccacgttagccaggcgggtttcaaactcctggcctcaagtgatacttctgcctcagtctcccaatgtgctgggattacaggggtgagctaccgtgcccagcctaagaagtcttataagactttttttcccttagttccacctcctcccccatgaaattttaataccacagatatactctatctcattttatgaaatgtatatctgtgttttatatataaaaagaatatgtgtgtttttatggccccaagaatcagcttttaaccccttgggggccatactccctctgcccctgccacacacacacactgagtatgcacaattggggtaaaaaaaaatcacattattttatgtctgaagtacagatatacattcagtacctaaagagatatacaaaatatttgtggattaagatttcatggtgggaggtgattaagaaaaaaaaaaaagcctaaaaaacctccttaggagagtaataaattttaaaagattatagaaggttgagaaactgtgatctaaacaggtggtttggaattgcccagtggggcccacatagaatcggaagtgtggcaaatgtcacagcagggatgggtagtgtcttagaggggcactagtgggaaacagggaccttgtctcccactggccctgaacatagcgggtaacccagaaccacactgtcactaaagccgacacctcaaagtggctcactgatatgcttatttgaaccactaaacttttttttaagaatctggaaatttcacataaaatatggacttatggctctcttgaaaaattcgaagacctaatgacactggagccacatttctgcatattaacaattaacatagccgggtatggcagcccacacctgtaatcccagcactttcagaggctgaggcagagggatcgcctgaggccaggagtttgagaccagcctggccaacatggtgaggccctatgtctaaaaaatattttaaaaattagcagggtgtggtggtgcatgcctgtggtcccagctactagggagacagaggtgagaggatcacttgagtccaggagttggaggttatagtaagccatcacaccattgcactccagcctgggtgacagagcaagactgaggaagagagagagagagataagaaagaaagaggcatatttaacttatttaccttccctctctggccccagcactggagcagagcagaaggaaggaactatgggatagaatgcaatttctttcctatccttatatctatttatcaaggagacttcaacaaacaacaataaaaactttattgaacacttgactgtgcacccggtactgtactaagaactgagtttcgttgtctagtctaactgtccccagatctctctggagtgtacataatcatcttcattttcctgatcagcaaccccagactcagaaaggtaaagtaactcgcccaaggtcacacagcagtggcacactttagttattatttctgtataaaaactacaccaaacttagtgacatgaaacaaccattccattgtcctcaagtttactatgagttggggattcagaagggacatagcggggatggcttctctgtgctctgcagtgtctgggacctcacatgagaagacttgaaggctagagatgagtcaacagcaagaatctaaaaatcactcacaaatctggcacctgaaaaaagatgactctaacactaaactcagctgggactgccaactgaccagatcacctacacacggcctccccatctggccacagcctctccatgtgcttgggcttcctcacaacatggaagcctcagggcacttcttacatgatggcttaaactccagcaagaatgttccagcaaacaaaagggaacagcactgccttttctgacctagccttggaagtcccatagttaacttctgccacattccactggttacaagcaagtcacccagattcaaaagaaggggacatagaccccaactctagacggaaggaggctccattgcagaagagcacatggaatggaagatattgttgcagccatcctgcaaaatatgatctgccacatggcagaaccaggacacaaactcaggcagatggctccggagacactgttgttaaccactaactacgttctacaggtggttatgagaattaagtgagataatacatgcaaagtgctcaggacagggaatggcacatcatatcgaattcaatacatattgctttcctgacttcatgcactctctttgcctctacacccgtgcataacctcacctatgaagtgcctggctacgtgcatctggaaacctggcatccagtgagctaactcaggagaaagactgaactcagcctaccccccaccatagctctgggtgagaatttctctgaggactccgtggaggaggccttgtctcgcccactctgtggcttggccatgtctctaaaacccaggcagggccagagagctgtgccccagccccagcagatgacccaggggactgaagttcagagttgaagagttcagaccctgcacagttcatgaatgttcctgggccccaaagagtaactggagaaattgtttgtatcagtgaggaatgacttaactcttggcaaatcctagaaaacagcctttcttcctgtttctagaggccttccaaagaaaagaaacagtttagattttgctcagctctgtggttgactacggactcccaccccatgggggacccatgggtgaggtcccagctcccaggagcaggggagggagcattctgggagtgcaaaccaaactatttggttctctggccaatggggcctctaagttggcttcagagaccactgagggatgggagtgtcatcaacacagatcccagaatctctcctctaagctttaccttccattcaagccgggctgggatcctcactaccccaattcgcctcaccccattccctcccaccgcctgccctttgcgagtgttgagccgccctcctggaacaccttccttcccatggccaagcaaactcatctgcattttcaatacccaggtggagctctacctcaaccatgagaaatcttccccgaaaaccatggctcaacaacagttttatttctctccctgaacttgcaacgcaatttacttcttcattcatgaatgcaataggtcatttttagggaaggcgttctcaaggcctttggcctcattacctgcttgacgctcttaaaaattatagaagacctcaaagagtttttgtttatgtggcttttgtctgttgctttttaccataataggaatttaccctgagaaattttaaaactatttattcattcattcacgtgaaaagaacaagaacaaacccattacatgttaatatcaggaggatgacatcaccacatgtcatgaagcctctggaaaaccccactgcgcacttgtgagagatgagagtttgaaaaggcaaatcacatcttttgttatatcaaaacaaaaatagctttgatctcatggattccctgaagggccccacagattattttgagaattactgtctaaggctatttagaggcaccaggttttctctgtctctctctcatctctatctctttctctcccttttttgataacttactatctctgtctctatctcaatctttgtctgtctccacgtaagccttcttctctttcatccatcactgactttttggtataactttagtatttactttactggtacttgttaacattttaaaaaattaaatagataaggataggaaaggaaaagaaattaggaggtcaaggcaggaggtcttgagcccaggagttcaagaccagtctgggcaacacagtaagaccctgtctctacaaaacagaaaacaaaaatttggcgaggcaaggcggtggcgtgtgcctgtagtgccagctactccggaggctgaggtgggagcatcgcttgagcctggtaggtcgaggttgcagtgagccacgattgtaccactgcactccagcctaggccaaagattgaaaccccatctctaaaaaacacaaagaaaaaaagagagaaaaggaaaggaaaaatcagcgtgcaaagcacagactcttagtaaagactgtgcatatcaccataaatatttttgttatacattgttccagatacagagaaggatgtagatataggtgtagatataaatatgaatgtgaatgtgggtatgtatttgttattataggctgtggtcagaagattttgaaaacagtataatagaagaccttttatggagatttctcaggataagacaatgtttagcaaaatgtggggcattctctcctagtggtatgggaaacaatgttttggttgcatactgcatatgcatatgatattaaacaacaatagtatattaacatcaacattaaataacattaataatccctgttcagttgtcttttagctactctgattacaacgaggaggaagtctcacttggtgaatagggtctctttaacattctctaatatttgctaatctcccttggtaatcgggacagacaaagcctgaagttcagagctctcagcagtcagcaacgtctcagtgggctccaaaacactgttttggattcaaatatatatatatatatatatatatatatatatatatatatatatatatagagagagagagagagagagagagagagagagagaggatttatatatatatatagtatatatatttatatctatgagtatatatataaatccaatacatatgatatccaaattcatatatattagatttaggtatcatatatatttgatatgtatactcatatatgaattcaaatatatatttgatatgtaaatccaaatgtatgtacacatattaaaaaccctgttttggattcatatatatatacatatatatttttcttaagtatcatatatacttaagtattatatatacatatttatgaatatatatatatatatgaatccaaaacagggtttttttatgtgtctatatatataatatatatttatgggttcatatatatcatatatatgaataagaatatggattataagaatatgaaataagaatatggattcatatatatgaatcaatatatatttatacatatgtacatatataaaatgttacagttgctatttacgtgtggcaatgatgctacgtttccatcatcttaagtagagatgtaacatttcttatttaagtaagtttattgcaataatcaaatgagttgctgtaaagaaatacttaagaaaataatatcacaggtggtgtgtatatctggcaaaaagtgtgagatgaaggtagttcccaaggggttaagttccagaaatactcatgttctggaatgaacactcaatggagtcaggcaaatgtggattcaaattggccgctctgccacccactgtctgtgaccttgggcaagtgactcagccagtgttgaggactcactgctcctttgggctctgagagttttcaaggatcaaagacatctgaggtaacaccagatgacctcaggagaaagaccccaataactctgtcccatactctctgctaaataaacactttgtgggcatgatctcatggctcactacaatcttgaaataaggaccttttttttttcttctacagatgaggaaagaaaggctgagagaaagggcaatgaccttgtcttcctcttaataaatgtcaacttctttttttttttgagatagggtctcactttccgtatttggaaagtgcaggagcagggatttgaacccaagtccatctgggtgtgaatctattttgtttctggctgcatttacccatcttcatggggacaggaagggaaggagtggccactcagacaccactcccatcatctcacctcctctttgtacctcctctactgatgctactaagcatggtaggaaaagttgagattgttttaagtactcatgttttagccataatttacttttactagctttgtaattaacacatgggaaaaaagcaggtttcccctgctaagtccaagagactaggaagatcaatgaagtcattgtcattgagttaaatattaagaggctgatttgtaaattcaaactcaagtttgcattttaaaaatataccgttgaattaaattttatgaggacaagttgtagaatatgcataatttttttctgatagaaaaaatccatctacccagcttatatttatattttagttttcaaagtctgacttgtaaacactcaacagttttcacccatatttcgataatcaaatgtaatggttggcacagggctttgtagtttgaaatacttgggtcaacaattctacatttctttctcttaacatgctattaaaatgcatggcttctgatcacaaatttactttcattcaagactgaattgaacaatttcagaatcataattttaactgttcccaactgatcaatggtcttagtttcaatttcaaattcccccagggaacgatcgtcgctgggcatagcttttatgcggggtcatcttatgggggaggagcattcaggcagaggggacaggaaggatgaggatctagagataagagtgaccctccttaagtgtctgaggggcagcaaggagggagcagaacaagatgagttcagggaggtgatgggagtagggaaagaaagatcatttgaggctcgttctccattgtcaggactttggatttttattctgaataacaccagaagcagttggggggttctgggcaaagaaacagcatgttctttctcaccttgaataggatccctcagaaagctgagttgaaaatggatgatagtgggggaagagtgaggactgtatccgataagccatgtgagcgattatgctggctcgggtcagggtgggggtcctgggagtggtaagaaggccaggattggatggtggattaaagtgatgtgagtgtggggaaaagggaggagccaagaatgatggcaaagtgtttagtctgagtcactgaaagagttggcttttattaagaggaagaccaagggaggagtgtgtgtgtgcgcactcatgcatgtgtgagtatgcgtgtgtgtgagtgtgaaagtgtgtgtttatgtgagtgtgagtatgagtatgtgtgagtgagtgtgtgtgtgtgtgtgaccatgagttaacttgggctgtgtggagtttgaaatgaccatttggacacccaatgggagatgttaactagatgacagggacacagcccggaatgcagggaaagtaaaccctgagagccgttgtagtagaaattatatccaaagttccagaagtgattgctgaatggctaaaggttgctgagggaaggaaaacttttcactaaaaggcaatttgaacattaacatgttattgcttctcaagaaattaaaagaggccgggcgcagtggctcatgcctgtaaccccaacagtttgggaggccgaggcaggcggatcacttgaggtaaggagttcgagacaagcctgggcaacatggaaaaaccccggctctacaaaaaatacagaaattagctgggtgggtggggtgcggcacgctcctgtaatcccagctactcagaaggctgaagcagaatagcttggacccaggaggcagagtttgccgtgagccaagattgtgccactgcactctagcctgggcaacagagcgacactctgtctcaaaagaaaaaaaagaagaagaaagaaaggaattaaaggggtcttctcaggccaggcaaagacaaagtggagcccaggggatatcgccccactccactgggaccctagcctgagagcagggattgtacacaggcatctaaactagggcaaaacacctggtctggttacaaaattacacccaatatgtctttcagaactgtaacccaggcacaagcctctgcctcttctttaaagtattttcccctgactctgcctgcttcctgcttttatgctcctctctacctctttgttgcagggggccccagtcaaaagagctcacctcacctctcctgatagattgcttaatgagtacacatccctcccatccagtaagcacgcccctttgcgaggtaaccctgaagctcctcccctccagaggtgggttctatttccccagccttttgattctgggcttgatcttctgacttgatttaaccaatattatgtagtagaaatgccagtgtgtgagttccagagcttgagtcttaagaggtttgaagcttctgctttcaccttcttggaaactccagactaccatagaaggcagctggtgcagcctcctggggaatgagacattctgtggaggagagtggaagcaatccctagtcaacaaccagccagacatgagggagaggctattagggccttttcagccccagccagtctcccaactttgtgcagctacatgagtgagcctcagcaaaaccagcagagaaactgcccagccaacctttagaatcatgagaaagaagaaatcattgttttgtgatttgtacacaatgacagataacgaatatacctttcttagcctcatgctcctcatctgtgaaatgggaatagcagtccccatctagtagagttattttgcacactaaccaattgactagatgtgaacatacttgcaagctataaaaaaattacatgtgtttattgttaataggcctcaatatattgagtaaaatatctgggcccctggaaaggtgatctaacagtattttggcacagttaacacaaatagagtgcttaggcacagaccaggcactgttctaagttccgtaattgtgctaattcatttaacactcatcatggctgggagcggttgttcatacccgcaatcccaacactttgggaggccaaggcaggaggatcacttgaggccgggagttcaagaccagcctaggaaacaaagcaagactctgcctctatgaaaaataaaatgtgagccagccatgatggtaggcatctgtaatctcagtctgtcaggaagctgagttgggaggatcgcttgaacccaggagttcaaggctgcagtgagctaaaataagcctgactgataaagcaagacaatgtctctgaaaaaaaagaaaaaagaaaagaaacccacttaccataagcaagtctacaaggttggaaccatgttttacaggtgaggaaactgagtcctagagaggttaagaacttttcaaatgtcattcagctaagaaatgatggagctgggatccaagcccaggtgacctggctcctgagcccttgttcccatgagataatggcaggcagacacggccaggtgcggtggctcacacctgtaatcccaatactttgggaggccaaggtgggttgatcatttgaggtcaggagttcgagaccagcctggccaacatggtgagaccccgtctctactaaaaacaaaaaaattagccaggcgtggtggcgtacgcctgtaatcccagctacttgggaggctgaggcaggagaatcgcttgaactcgagaggcagaggttgcagtaatccgagatcacgccactgcactccagcccaggcgacagagtgagactccatttcagaaaaaaaaaaaaaaaaaaaagacaggcacatccaaacagacaccttggacagctggacactgcgggaaaagctgcaccctgctttaatgtgagagagagtttccatgtggttgttatttggtggtggctggagatggaaccaaggtcagttgtctctggaaggttggctgcctcagatattgacttctgtccttcctgtgctccattacctttcccttctgttcaactggggatcaggctttgtgggccgttgtttctggagacttttgtgtcagggcttcccggcttctatttcccaaagccatagtcatttgcagaagactgaggttttcctacactgagaagaaatttccctgaattgggtaaagagcagtgagttctgtgggttctggagccctgaagcaggcagggctgggggatgcggttgttactccctgttctctggcaggatatattagggctcattgcaggctgcaccccaccaccttgccctagtaactttagtttcttgtctcagccacggtttcctgtcccaggcacggaaggggacatcagagctaccgcatctgaaggggccctgtggactgggacaatgggcttctcctgggtcaccagtgagtaccattgactggtactgcctaaaactgcagaactgaaaatcttggtacagcccaaaagtaggggcccaatgagccccaaccatgacagtggttcagggctcagactagtaagaaggtagatttagtagagcatttccaaatttcaattgtttgcaaactccctgcaagtagagttgccagataaatgcaaaatacccagctgttcagcctgtcttttctcctgaccacccccacctttccagtattttggacattcttatactaaacaattatttgttgtttatctacaattcagatttaacagggtgtcttgtattttttatttgctaagtctggcagccctagcttcaagatttttaccataaccacacactacctcatatacttgagactttatgagaacaaaccaactgttctaacatttagttcatattttctttaaatccatatgactttttcatttaggtaaagttatttttaaggaaatttgattccactaataaaaatggaaaactggtattaattgccttaaacagaagtaaccgtaaaaatgatatttgatgagagccaagcaatgttttgaagctctagctgtgttcttttgtctccctgaggcccaccctctctcttacaaaaagatgggggtgttagagagatgctaaagagaggctagcagtctagggagactttttctttgaaggactgaaggaggatggaaggggaaagaatttctgtccatgtgagtcaatgctatacaacctcaggtccatgtactgctctcacctaaaatcttttttactttttgttttttaatttttaatatagaaacagggtcttgctgtcctgcccaggctggtcttgaactcctggacttaagtgatcctcctaccttggcctctaaaatcattttagcatcctatgctttaggacaccctgatttacagaacattaaggaatgtggaatttgttgctcacctcagtttccgactggagattggtatcaaagttcaaaattgataaaaagaaatatctgcaccagactttgctctgggcatcttacccacatgaccctacttatttctcctgacaaactaagcaaaaaagtcctaccatttcccccacccttttttttttaatgcagcaatagagacatcacttcccatcaggaacgcaatctgtgttctcaagaacttcgcttatgttgatctctctgtacatacctacaactcctcccaagctccagagatacaggttaagaaggaagcatccaaaaaaccctttggggccgtcttgcccatctgtcctcctgaaccttcatgctgcagccctgctcccaggttatacttgggaaactcaaataacctaatttcaaggcaataaaagtttccaaatttcccagaggacagaagattttgccctgagtgtttcccacaatttgtaataacttttcctttgaatcgccccgaattcttctctgtcctaacaagttagtaagatctggcttgaagtgctggtccatgttctgccttttgatctgccttctgcttagaaggatgtgttacctgaaagacaatttattaagctgtacccttatgatctgggtaccattctgtatatttcaacaaagagttttaaaaattagaaaatataactcttgggtttatacctaaaagggttgaaaggaaagattccagcagatattggtatacccatgttactacagcattacttacaagagccaaaagatggaaacaaccaaaagggctatggaccactgaatggatgtttaaaatgcagtacacacagacactagaatattcttgagccttactaaggaaccaaattctggtacatgctacattatagctgaaacttgaagatattctgttaagccagacacaaaaagacaaatattgtgtgattgcacttacatggggtacatagaatagtcaaattcatagagacagaaagtagggtggcagttaccaggggctggggaagaggaaaatgaggagttattacttaataattatggagtttcagtttgggaagatgaaaaagttctgaagatggatagtagtgatggctgtacaacaatgtgggtatacttaatactgctgaattctacatcgaaaaattattaaaatggcaattatatatatatatatatatatatattttttttttttctgatacagagtcttgttctgtcatccagtctagagtgatctcaatctcgaagtggcacgatctcagctactgcaacctccctctcccaggttcaagcaattctctcacctcagcctcctgagtagctgggattacaggcatgcgccacaaagccgggttaatttttgtatttttagtagagattgggtttcaccatgttggccaggctggtctcgaactcctggcttcaagtgatctgcccacctcggcttcccaaaatgctgggattacaggcgtaagccaccacacctggcctattatgtatattttaccataataaaaaattctaaaaacaacaacaacacaaaaaagagctggctgatctctcagaagggctgggtttcagtgtctggtaaacaccattcaaaacagagatgttctgattttgatcgcggtttttaaaatattcaatcaattaactttttaatttagagtttattagtagaactactttagaacaactccccatccttcagaaaaaaaaaagtacatctttaatctatttgcttaaacatatacatatttctttctagtcttgtttaaccattagcagtgttatgttattgttatgggggtagagggatacgatatacttacagttttggagtttgcttttttacgcttcacaaaatattgcatgtaccaagggtcagcaaacttttcctgtggagggccaaataggaaatatttgaggctttgcaggctgtatggtttctgtggcactgcttgtctgtcactgtagcacaacagcatccagagatggtacattaatgaatgggtgtggctgtggacaaaggaaaattcttacaaaaacaggtggcccagggtcacagtttgcaggcctctggtatcctatacccatatgcaatatagctctgtgatgaggggctgagggcttagtatcaggggagcctgggttccaattttggacattctagccctagttgtagggtctatttgtgcaaattgtagaacatctttctgcctcagttccctcatctgtataataggactaataataaccagatcccagtgttgggattagatgagctaaggtgtgtaaaaaacatggccagatcctgtgcacggcagaatctgtaaaaacagtggatgctacgttacttgctatcatgagccaagtttcttgtttgtctttcatccttctgtgtgttagtccattgagtaaatacactttaatctgcttcattatttctcccagactgtctactttaaatcattcaacacccttgaagcaccgaggatgaagaaaagaagctgattttcatttttggactgtctgagtaaatgtgtttggggaggggagggtgtttaaagacataatcaacagtgaaatacttgcttgggaagaatttttctcccctcccccaaccaagaaggctactcaaagatatgaatgtatttcagaattctttgagagctgggctggattaggtaggctcttcactgaaggtaagagaaacttaaaattgcaatggggcacctctaaacaaaacaaagggatttgttacagggaagtcaagggtgttttatggaatgtaaaatccaaaaatgcagcccagcctcagcaggtacaggataatgaatgaaaagtgattgggatcacgtgaggtcaggagttcaagaccagcctggccaacacggtgaaaccccgtctctgcaaaaatacaaaaattagtcgggcatgatggcgggtgcctgtaatcccagctactcaggaggctaagtgggggaatcacttgaacccaggaggcagagattgcagtgagccgagatagcaccattgcactccagcttgggcaacagagcaagactccgtctcaaaaaaaaaaaaaaaaaaaaagtgattggggcaagaggtcaaggttccactgggccaagacaatggtatctctcattttcgtacaacagagtctctcccgtctgcaattccctgcagaaacaggttgatatagtttggctatttgtccctgcccaaatctcatgttgaattttaatccccaatgttggaggtagggcctagtaggaggcatttgggccttgggggtggatttctcatggcttggtactgtcttcgtgagagtgagttctcatgggatctggtcatttaaaagtgtcctgtacctccccccaactctttctctggctcctttgtttaccatgtgacatgccttcttcccctttgccttctgttatgattggaggcttcctgaggcctcctcagaagatgatgctgctacgcttcctgtacagactgcagaactgtgcgtcagttaaacctcttttttgcgtgtgaattgcccagtatcagatacttctttgtagcaatgcaagaaccgtctaatacacaggtacattttaatttcaccctttaaatcttgttctatgtgcagcttccttccttggatccccgccttgagacttattgtcacatggtggtggcaatcactcacctgactgagacgaggaaagaaaagcaggcatgtgtttgtgtcttaacttcccaccttggctattggccaggagataggggttttggccaggagatgcggcgattgcatcagacagaggcgggggagcccgaggaaagaggagttctccacaccttgatcaccaccgaaggctctggatccttctctctggctgatttgaccacacccaggagcagtgacatggaagtgaacttggagaggcaagttgatgagaccgagcgtggccttggtttcctgctttcccctgctattcctggttcctgtgctgtaaggatgccacctgacagttcccatggcttcagaaggtgggactcagaaggtggctaaattgaaatctagtactctctagcatggggcctgcattaatccgttctcacacgactataaagaaatacctggctgggcgcggtggttcatgcctgtaatcccagcactttgggaggccgaggagggtggatcacgaggtcaggagatcgagaccatcctggttaacacggtgaaaccccgtctctactaaaaatacaaaaaattagccgggtgcggtggtgggtacctgtagtcccagctactcgggaggctgaggcaggagaatggtgtgaacccgggaggcaaagtttgcagtgagccgagatcgcgccactgcactccagcctgggtgacagagcgagactccatctcaaaaaaaaaaaaaaaaaagaaaagaaatacctgagactgagtaatatataaagaaaaggggtttaattggctcacagttctgcaggttatagaggaagcatgaggctggcatctgctcggcttctggggaggcctcaggaagcttacagtgatggtagaaggtgaagggaaagcaggcatgtcttacatggctggagcaggagagaaagaggaggtgctacacagttttaaacaaccagatctcacgagaactcactcactatcatgagaacagcaccaagagggaaatccaggcttgtgatccaatcacctcctaccaggccccaccttcaacattggggattacaattttacatgagatttgggtgggacacagattcaaaccatatcagggcctgtggtggtgagggcagcatgaccctttgcagaacctgtggtggaagatagactgcccaggccagaggctggtggagggtgtggcagccacttgggggaagagggttggctcaaagagtcccaaagctaaggagagagggagccagtggtcaagttctggctgagctgaagagcagaagtccagttagccatcagcttccaccacagaggtgagcagcaacttgaggatccatgatagcaggacaagctgcaggtgcaaagacatcttgccttcaggccacccaggtcacccgagctcaaccacccccaaacccacggaggtcattttggcagagcggacacagaaataggagacccaattgacccacaggctgagcatcacctggaagaactatttgaatcactagattagactcttttttttttttagacggagtctcgctctgtcacccaggctggagtgcagtggcacaatctcagctcactgcaagctccacctcccgggttcacaccattctcctgcctcagcctcccgagtagctgggactacaggcgcccgccaccacggccggctaatgttttgtatttttagtagagctggggtttcaccgtattagccaggctggtctcaatctcctgacctcgtgattcacccacctcggcctcccaaaatgctgggattacaggcgtgagcctccgcacccggccagactcatttttaaagatagtttttaaaaaaaattctttaacgtaatagtgaaagggtcagtacgtttttccataaagggccaaactgtcaatgttatatgttttccagactatagggtttctgttgtgaaaactcagttgtgctgctatggtgcaaacacagccacagacatttgtaaacaaatgtgtatgttctaataagactttattggcagtgaaatttgaatttcgtattatgtttatgcatcatgaaatgtctttttatttttttcaaccatttcaaaatgtaaaaaccattgttagctcgtgggttgtacaaacatgggctacaggctggatttggccaatgaactgcagtttgctggcccctaaaatatttgattcatataaaaattatgtcagatatgttataaatcacaataataaatcaaaaacctgtgaacccagcacccaacttaaactcccaaatattaataccactgactccatcctctctctcccatcactctgcctcccccaccaccctgccccaaggggaccatgattctcaattttgtgctttcagttcagctttttcttttatagttttgtcaaatacatatgcatccctaagcaatattcggtaaaattttgcttctgtgggggctttgtaaaaatgatatcatattgtacacagtttaaagagacaggtgctttttaaactcagcatcatatttctaagatttttccatgttgtttcatgcagctgtggttcattaattctcactagacaaagtttttgaggtgagtccacaggtacgctgcctctgagggtactgctgatgggaacaagctttctgaacaggattggaagccacacgccactcccccagcaccacccgccctgccttgccaccactgctggtgctgttgatggtgccgctgtcatactgacagaagcatcgccaggagctggagaaatggcttctcctttcttgcaccttccattatcccactaatgtctcccattggtagaacctaccaaatgtcagtgcacaggtatctaggaaatgtggttagcagctttccaaaagccctagcagtaaagaagagttgagtgtgggtaagtagagctgagagccaacctacattatccagctcactcactgatgtcattcccaggaattcttttttttttttttcgagacggagtctcgctctgtcgcctgggctggagtgcagtggcgcaatcttggctcactgcaagctccgccttccgggttcacgccattctcctgcctcagcctcctgagtagctgggactacaggtgcccgccaccacgcccggctaattttttctatttttagtagagatggggtttcaccgtgttagccaggatggtcttgacccctgacctcatgatccgcccgcctcagcctcctaaagtgctgggattacgggcgtgatccacggcacctggccattcccaggaattcttgaaggctgttgtttatttcatgcttagggaacattgcaactctttgattggaagagttatgtcgctgaatgccatgaaatagcatgaacattaagtggaaacagtagggaaaggtggctatatgcctctttgtctttcctaatacagaaaatgaaaggagcaaatcctggctcttccctcattgggccatggagaaatggtggggctgattggaaggttacagctgtgaagtctccagtttttcactttgaaagaacatagccctgtctgccagcaaatgtttaccaagcacttagatatctgatgcagagaaaacagtaatgcttgaaaagtcaaagatctggtccataccttcaaggagattacaatctaattgaagagataagatattcactcatggaacaaacagagaacaaggaattcagtggtaatagacaccaaagatggtgagcatgtggcacacataccataactctccattcccagacccatagcaggcattactaatcaatcagatcttttttctttcttgatgaatctggattcaatcacagaattctttaacacagtgattcagacatttactcttaatttctcaaaattgatagatgtagcccactatatataggttcagtaattttcgttaactaattggtctaatcaatgaaaattactaacagcctactatgcaccattcgcagacataggcacagtggtaattaccacaggaagacttgtgcttgtggctcagagtgtaggcagagaatcaaagaagcaaacagaaaatgacagtgcagtggtttaagtgctaatatgtggaaaacagagggttctgtgaatgcacagaggagggacccaacccagatttgggaatcagggaggactctaggctgatacctgaaggataaacaaaagttaacgaaataaaagggaaagtgtattcttcaggaagcgttcagttgcaattgacagaaacctagctcaagttgctttaaacaaacagagaaatacacatgtgttcatgtaactgaaatacattggctcacgtaactggaaagtcccagagttgtttgcttcaggaatggctggatctaggcgcttgagtgatgtcattaggaatccatctctatctcttgagtctgcatgcctctctgcagcttcatttcaatcagggtacacattcatggtggcaaagacattcatggtggcaaagacattcctgtgcagttccaggctgacatcctgtctgcttaaaacctccatagaaaggcacctcacaatagtgccagcaaaagtcctgaggttgactctgctttgcccaggcttgattctgttcgaccccatagcttggtcatacccacccacagtatgcggatagagcagactcccaaggagactgaggtgcttttaccaggaaaagagggaactatgccaggccaggaaaagggagatgaaaaaacttgatctctgcttggaagaaggaagcaaaggagggtaccaggcagagaagctgtgatgcatccgaggagaagttcaggatgcgatgtgcagcatctgagtgtggagtagagggatgaatctggaaggcggcaggaggcaggtcagatgaggcctcttaaccacgttagggatcagcctttatcccaagcacagtgagaagccatttcagggctttaagaaggagactgaagattctaaatcgccctcacttttgatgagttaacagcattatgggaagtggggagagaaggaagaggcattaattttcaagatcagtccttaaagtaaccccgtcaaagcaaaccatgtaatttagcaaatcacagtttccattgaaacttgttcaggtaatacgtgctcctccaattagtataacagcccagagatgcttttccaggacaagatggcctttgggtcatcatgttctttgctgcaattcactcaagtgatttcattccttagttgaaagaagtggctgcttgtaccaagggtcactgaacaccagtggctacaattttttgaaataggcttcttgtagcacctactgaccaacagcctcaagcctgaggctttgagagaatgagcagagttaacccttcagcagcctcagccctcacccagcaggaaggccacagctgtcctccagtgcaggacaaatcctgccctggaaaaaaaccatacagggcaagcctcagttccgctcataaatcaatgtctgcaagtctgtttctacgtgtagttaagttacacggaaaagtacaactggatttgtccccggttttcccattagggataatataaagtggaggcggaagttaattgagttcagagttcgccgtgtgatgtcagggaagcggggctctggcaagcaggtcgtgtgtaacatgtgttctgagggtagtgttttcacacaacctccctgggggagaaaagcgttctttcaccaggagtgcgatcttcagaaaacaggcttctggggttccaaaggggctttcacctacattacaggataaaggtctcattttccttacagagacgttcgtgcaatgagcatgcctgtgatattcaagaaagggtaataaaaacccctgcctttcaacaagagtcataaaggtcggtggttcagaatagagaccctggagccagactgccagatcagtcagtcacaagtagggagacagggcaaggatcacttcactctctgggcctcgattttctaatctgtgaaatggagcattcaattagagcctctacctcataaattcactgtgaggattaaatacgttaatatatatcaagtgctataaacagtgcctggctttcagaaattaccacctatggtagggcgtggcacttagttctttacaggcattatttcattgcataatttaaaaaataaagaaaaatgttgtgagttggcgaagattgatttaccataaggctgctgaaatttaagtgtcagggtcttcactttcactgcctcttccaaagctctggaagggccccagaaataagctcacaaaggcatgtactgtaataattgcaaaagtacggtctatttcttctttttttttcaagacggagtctcgctctatctcccaggctagagtgcagtggcacagtctctgctcactgcaacctccgcctccaggttcaagcaattctcctgcctcagcctccagagtagctgggactacaggtgtgcaccaccatgcctggctaatttttgtatttttgtaaagatggtgtttcaccatgttgtccatcctggtcttgaactcctgacctcagatgatctgcccaccctggcctcccaaagtgctgggattacaagtgtgagccaccgtgtccggccagtaagacctattcctatctttattcttataagggactctaaaattgtgtaagcctcagcccccacaaaaaatggattctctctgggaagaagggcttcttatttccatcttgaagatgagaaaacaggctcagagaggcccaaagtcacatagctagagaggagtggagccgggactccagcccgagtctgtctgtctggcatccactgcactcctctgccagccttgaggtggggacaaactgagccacaggtctcagcagctggggcttgtctggccagttggccatcacaaagcgtggcttccaggaggcacaaatataaacatttttctgaatgaatgaatgaatgaatgaatgaatgattttctaccatctcctcccatatccaattcaagaattccggaacttctttcccctattgcatgcatcttagggaccacagggggttgttactgaggtgtgaccttcctctgggctgggagaggacatgggagtgacccaagctaggatgacctggggcttcctctgtggaatttgagctcagagtgaccaaaagactgaaacacaggtgagctcattccttggtgctgcctgtttctctccctggctctacagccttcctgacaattccgtgagtcctgatgtcctacaaagtctccttttctggagatggccaagagtggggttccatgcccacaatcaaaactgcaatcaaatgacatgtggctctccctgaggcttcatcgctcactctggccacacatctgtaaaagtgatgagtcagctgttcaggggcacgtgggtgaaagggatcttaagcattctttagctcaggcaccatttgaggactctttctctcaacataccccaaccaaatggtcatccagcttctgtttaaaacctttcaagggggttcatttcagctttgaataattctcttagaatgtctcctattagacattcctcctattagatgaaaatccgtattcctccctctcactgtcctttttcttccttcatttcttccttccacctttcttccaagttttcttccctctctcctctcacttcaggaagatttcacttgtctacccaccagaggccaggcacatcctgtgccaggccatgcaactactaggatagatgttacaaagtctttgttttaaacacacctctccctgatgatgcagcgattttgtttctaaatatttacccaaaagaaatgaaaacatacatccacccaaagacttgcccatgaaatgttcatagcagcatgattcatagtagtcaaaaagtagaacaagcccgatgtccatcacctagtcaatggacaagctcaccctcactgtggcaaaggagtcccatctgatccctgggggatacattccaagaccctcagcagatgcctgaaacctcagtcagtcctgaaccctatatacactgtgttttcctatacacacctatgataaagtttaatttataaattaggcacagtaagataacaataatggataataaaatagaacaattataataatataatgttcaccatttcacatatcgaagatccatccttatcatagatcttagcaatctcggcacacgattttttttccttttcttcctaagtcaagaactttcacatttttacttaaaggaagcactttctggcttctcttctgcctatctgaattgttgtcatcactactaccccttatgctttggggccatcacgaagtaaaataagggttctttgaaaataagcacggcattactgcgacagtagatctgataaccaacacagctgctaagtgactaatgggcaggtagtgtctacagcgtggacacgttggacaaagggatgattcgcaacctggacgggaaggagcagggcggcgtgagatttctatcacactacacagagcaacgtgcaatttaaaacttagaaactgtttatttctgggattttccatttagtatttttggacctcagttgacgtcgggtaactgagactgcagataaagggggacagctgtatatccacacaatggaataccactcagccatgaaaaggaaagaacttcggatccatgcaataacatgtatgagtctcaaaagcatcctgaactgaaaaagtcaggcccacgagagtagatactgtgtgattccttttctatgaagttctagaaatgacaaacccaagctgtagtgacagaacccagaccatgatttctggggactaggaatggcagtaaggattggctgagagaagcgcaggttctttctgagctaaggtaaatgttctgtatcttaagcgtggtggtgttttcgcagatgtaggcatttgtcaaaagtcatcgaactggctgggcgtggtggcccacgcctgtaattacagcactttgggatgccgaggcaggcaggtcacctgaggccaggagtttgagaccagccgtgccattgtgctccaccctgggcaacaagagtgaaactctgtctcaaaaaaaagaaaaaaaaaacaaaggccgggcaccatggttcatgcctataatcctagcactttgggtggcgaaggcaggtgaattgcctgaggtcaggagttcaagaccagcctggtgaacatggtgaaacctcatctctactaaaaatacaaaaaaaattatccggacttggtggcacacgcctgtagtcccagctacttgggatgctgaggcaggataatgtattcaacctgggaggcggaggttgcagtgagccaagaccgtgccactgtactccagcctgagggacagagcaagactgtctcaaaacaaacaaacaaacaaacaaacaaacctcatcgaactgtaactttaaatgtgcacattttattatatgtaagattttccaaaactgcctacttcaacaagctctcagcctgattaggggcatcattcaatgatgtaataaaccccgaatattttcaaaggtaagaattttgtgggttttttttaactttgagattatcttttaattctaatgttactcaataatataaaataatttatttgacagtacaaaatattcacaagcatgtggactaagagcagttgtcacaagccactggtagaagatcagcctgtcattatcttgtatccaggacccagcagctccattcctagttctgtcttctacatgggtcccaggacacctgcatgaagatgttcattgcagcgttgtttataatcgcaaaaaactgagagtgggaggagactctgaatgtccaggagaatggaaaaagtataccattgtacgtaaatgaacattaaatggcagagaagaaggaccatgtatcaagagagacatgtctcaaaatcagtgtcaaatataaaaagcaagtttcagaaagatacgtattggataatatcatttataaagtgtttctgaaacatggaacatgtattatacattctgtacacttgcatatttaagtagcaaaattataaaaaaaaaacaggaatgggaataaggaagttaccagtataaagattacattatgggacagtgctgtgattaggagttcaggctttggaatcagacggactggtttgaatcctggcttggacttaacttctctgagcttttgtttccttacatgaaaaatgggaccaataatggtatcaacctcataaggcttttgtgaggattaaaggaaataatatgtataaaaccctgcactccgcagtgtatttataagatttagatgtacaggaggtataaagaggtgacaataaaaccaccaatctcagggctgtcttaaattaagatttttttctaattaaaaaattaattttggaattatgctcatcatagagaccgtgaaaattacagatgtatatatatatgtgtgtgtatatatatatatataaagaaagaaaagaaaattaacatgtccccaaatctccctaccctggaaaacactataacattttaatgactttccttccagtcttcttttggcaatacgcattcacacgtacttagatgagggggttcagaggagaggcgtgaatctacacatctctctgtctatctatgagaaacatctcccagcttactatttgtattctgcccttttcattaccacttggggcagactctgtaagtgtctgaagcaattccttcttcttctctaccaacataacccatttttgtttatgtattggccagaattctcctgatctcagggaagatgtatagggtagtcatgtgatctagctatggccaattaaaagtaaaaataggctgggcatggtggctcacgcctgtaatcccaacactgagaggctgaggtgggtggatcacttgaggtcagaagttcgagaccagcctggccaacatggttgaacgctgtctctaatgaaaacacaaaaattagctggcatggtggtgcatgcctgtaattgcagctacttgggaggctgaggcatgagaatgggttgaacctgggagacggaggttgcagagagctgagatctcgccactgcactccagcctgggcgacagaacaacactgcatctcaaaaataaaaattaaaaaaaaaaagcaaaataagtttgatgtggaaacttttaggaaggagttttgtatcctgataaaaagcaagactgaagttctgccccagtcctggtcgcacatatcattcttgtctttgaatgagaccatgatgccaggagctatggcagccattctatgttcatgagacaagcagcctgacgacaacggccaacacaatgaagaggatggagcagaaaaacagaagagcctgggtccttgatgaccctgttgaggggccagaccagccctgaggccactaaccttcagacttcttataaatgaacataaatagcctcatgcttgaaggcaccaatggtctgactttccattaccttgaggccaaaagtattgcaaatgcagacttattgtagaattcttggaaattacacaatgtttcaaagaagaaaatggacatcatccaaaatctcactacctggagataaacactattaaatattttggtatattttcttattttcttctaaccatagagaaaagtctttctttttttaaaagtgtattgcttgctatttggcttactattaaattaagtgtttctttccttgttattaaagagtctttgaaaagtttatttttaatatccattgcttggatgtattgttacaactgacacgtttggtttgacttctgtcatgaagataaaacaagaggctttctgtttgtgggtgtttgtgcattttcttttcctgcttcctttgtttccagcttttgctatgtggatttttcactgtgcctgaaaaagttcccttcctctagcattgtggaaggtaattcactcttcacaggactctggatttcagatttatagtttgaggcgcatttccttgatccttttgagaatcacacattgctgagtcctgaatttcagctcttataggggcgtttcttaccatttgatgagtaaatctcacaaatgccagctgttgctagcttacaaggaatcaagtaccggaagttctttctccaaactggagtgcattcccagcacatcctatggggtccaaatctccccatttcataatctttgtcagggagaagtggtgtagagaggacaaaaggaaagaagttttctttgctagatcataaacatgctaaagggcaaaattaatacaggtgatacccttttagcaacacctaagggagtgagcgaggataatttctgtgtgctgcatctttgtgtctaaaacatcatgtgcaattgttttatttggttctctctgaacaattcttcctggacgcacaggagccagatgtggaaaggtgaggccagaggaggcataacagatcggttggcagactctggacttagccaagggttatgtctgagtgcattcagctcaagttgggagccacctggtttgatattccaaaagtattggtggctgctttgccagaattagttttgttttgttttgtttctgatccccagatggagttctgatggctaatgtgcacttttccttcagttacaaaaatttagaaattaaccttattagaataaaatgcatcaaaatatagggcctgtaaagtccaagtaatttcccctgagatcaatcttgatgcacgttatatccaaatgcagatatattaaatacccttggaggctagatgtggtggtttatgctcgaaatctcagcactttggggcctacctaggcaggaggatcacttcaacccaggagtctgagaccagcttgggcaacacagagagatcctctctccaaaaaaaaattaaaaatttgactgggcatgctggtgtagtcccagctatttgggaggctgaggcaggaggatcgcttgaacccaggagtttgaggatgcagtgagttaaggtcgtgtcactttactgcagtctgggtgacagagtgagacctcatctctaaaaaaaaaataaaatagtaaaataaaataaacatacccttggatttaagggatttggccacttatttatgcttttatttatactggaagagagaagcggcaggaaacataagtacatgggcagtggtttgggtttcaggaaagttaggatttgtgtcccacccttaccacttcctaactgtgggatcttgggcaaattacctaacctctctaagcctcagtttcttcaccttgaaaatgatatataatgctacctgttttataggttttaaactttaaggcatgatttatattgatatatatttatgtaatcaaatgcacagttcttaaatgctctgttcaacgaacttttacatttatatacacataactaaccagcacctaaataagatatagaacatttctaaggccccatctggaaagttctcccatgcttctttcagtcaatgtcccccaaccccagccaaccactatttctatcatcaaagatgagttttgcctattctagattttcacataaatgtaatcatacagattactattttgtatctggcatcttttactccacctaatttcaaccatgtgtgtgtcaatagttcattcctttgtgctgaatagcattccacttaatgggtgtaccaccattttttatccattaatctgttgatggccatttgaagttgtttctagtttgggggtattacaaataaacacaaattttaaattttgatgtatttcaatgtatttttttttttttttttttgagaaaagtctcactctgtcgcccaggctggagtgtcatggtgtgatctcgactcactgcaagctccaccttccgggttcacgccattctcctgcctcagcttcctgagtagctgggactacaggtgactgccaccacgcctggctaattttttgtatttttagtagagacggggtttcaccgtgttagctaggatggtctcgatctcctgacctcatgatccacccgcctcagcctcccaaagtgctaggattacaggcgtgagcgaccacgcccagcctcaacgtatctatttttaaaatacaattagcgcttttcatgtcctgcacaagaaattattttcccagatgtgagagtgatctggctgtgaaatctgtcacctcattgattggcagggttgattcagctgatctggctggctaggcaagtgtccccttcttccctcaccactccatgtgtgtccctcctgaagctgcacactcagtcgaagagcatggccatccctcatagaggaggaccattcttcggtcaagggtatatgagtagttgtgctcccctactaaagcctccaaacaagctctcaagaaatcattttccctcctccccaaggttttcttccagaagcattatggttacgggttttgcattaaggtctatgatgtagctggaattcagttttgtgtgtggagtgagatagagctcaaggttccatttgtttcttccatacagatgttcaattgttctggcaccacttgtcaaaaagatgttattttcctccattgaactgacttggcaatttggtaaaaaattgattgaccataaaagtgtgactctatttctggatcttctattttgtttcattaatctatttagctatccttatgccaatactatactgtcttggttaccatagttttctttacattaaatcttaaaaccagtgtaagttctccagcattcttcctccagattgtcttagttattctagagcctttgtattcccatgtaagttgtagaatcagtctctcagtttctccaaaaaggactgttgcaattttgtctctcagtttctccaaaaaggactgctgcaattttgataagaattgtgtttactctatagatcaatttaggaagaataaacaacttaacaatatagagtgttccaatccatgaatattgtatatttctctctatttaattagatcttctttaacttctttatagttttaagggtagacctctcacaaatctgttaggcttatttttagatactttatttttttatactattataaatagtattttaaatttttatttttcaattgttggttgctagtatatttttctatattgacttttatcctttaaacttgctaagttttcattttagtcttagtagctcctttatagattccataaaattttccatgtaaacaattgttacttataagaacaacagtttcccttcttcctttccaatctctatgcctttttgttcttctttttattgtcttattccattgcttagggcatctcatatgatgctgattagaagtagtaagaagggatatctttgccttgttcccagtcacagaggaaagcattcagtctttcgccacaaagtgtggtgaatgttgtaggttttccatagatagatgccctttattagactcaggagtttccttctattcctagtttgctgagagtttttatcatggatgagcgttgaatagccagatgacttttacatatattgaggtgatcatatgaattttctccttgattctgttaatgtggcaaattgcattgatttttctaatgtgaaatttacttttacattcccaagtcaatccccattagggcatgatatgttatcttttttgtatattacttgatttaatttgaaaaattttattaaggatttgcatctttatgaggaatactgttctgtaattttcttttcttgtgatatcattttctcctttgggatcaggtaatactagccccataaaatgagttgggaagtattttctcctcctctgttttctgaaagactttgtgaatcatttgtattatttcttccttaattgtttgatgaaattcacctgcgaaaccatctgggcacttttctttaaagtgcttttgactatgaatccaattttcttgtagcttggagctattaaggttttctagttttcttgtgtcatttttgttaacttgcattttacaataaatttttccatttcatataagttgtcaaatgtattaacataaagttgatcaaatatcacattaatatctgccggataattctgatgtccttgctttcatttctaatattgacaatttgtgttttctttcaagatttcttgattggtcttgcaggtttgtctctttataaacttttgattatgtccattttctcaattatttgcttactacttcatttatttctgctcttatttttaaagtttcttgtatattctttggttttattggctcctgttttattagtttcttaagttaggtgtttaaatgactgattttatcccttttataatataatttctaattcatttcaagctataaatttctctgtaaacattttttagcaaatctcagaagtatggtgttcattatcactcatttaagaatattttcaaatatctcttgttatttattatttgtctcatgactaatttaaaagtatgtttcttaattgtggaatattttggtgttgtatggatatctttttgtaattgatttgtaatttaataccttggtggtaagagaatatattctatgtaaactaatcttttgatattttttgagacttttgttttatggcccagcatagagttcatttttgtgaatgttctatgtgcacttgaaaagatatgtagtttgcagttgttgagtgtttgttctataaatgtcagttaggtcaaattggttgatgtttttgacatcatctacttccttatcgacttttttgtccagtttttctatcgattactgaatgactgtgttaaaatatctggcatgattgtggatttgtctatttctccctttcattctgtcaatttttgttccatgtatttcacagctctattgtcaggagcctactcatttgggattgttatatcttcttcacttgatctcagccaatgggctaagaagtgattgttacatcttcttgattaatttacccttttattgtgaaatattcactcaagactagagcactgtcattgtgctctttgccttgaagtatattttgtgtgatactaatattgccatatcagctttcatcatcttatgttagtatatgtcctttcctacttgtctgtctgtctttataattaaagtgtgtcttgtgaacaaattatattgaatcttgttttctgaatccagtataacaatctctaccttttaactggagtggttagttcatttacttttaatgtggttattgatatgatgggctttaaatctactaccttggtatttgttttctgttcatctcatttgttctttgttcctcctcctctacattcttttgggtaaagcacatattttttggctttctcttttatttctactattgactttaattatatttctttgtgttattttcagtgactgatccacaatatacattttaaggtatctaaatctattttctaataatattaaactattttaccttcagtataataaatttacaccataattccttttatacgtgtgtacttgtatatatgatatcaactccacaatatcttgctattttttaaatattcaatgaacttttaaaaaattatataaaataaggacatttaaaaagatattttacatttatctgaatattgaaactttctggtgctccatcatgtatcattttccctcggtctgaaaagattttcttttagtgtttcttttggctagtgcagatcttttggagatacagtatctcagcttttttttatctgaaaatgtctttatttgactttcctttttgaaacctgtttttactggaggtagaattctaggttggtagactttctttttaaatttaagcacttttaagatgatccacttttaacatttcactgacttttgttctccagtggtacagtattaggtattacttgtgttatttttctcctgtatgcaatgtgtccttttttctctagttgctttgaagatttgctctttatctttggtttttagcaatttaactctgatggacctacatgtagttttctttgtgtttattttgctgggggctcactaagcttcttaaacctttgggttaatatctttcattaatttggggagaaaaattagctattttctctttaaatatttcttctcacacattcactctctcctcaacttctggggtctctagggtctctgagtttttctctctttgtgtttcagtttagatattttttctttacgtatcttcaggttcacttatgtttaccttggctctgctcagctttcagttaagtatatctgacaaactcttcattgctgatattgtattttttaaatttctagcattttcatttgggcattggtgtgggccatgtgaagactggcaaatactatgacgttcttctcttcctcaatgatggctctggttttctccttcttgtagaaattccgtatgggcattagtggtcttgtcagttgggtggccaatttgaactcttcacagaactgtctccctttttggggcccaaggacttcctggcaaagaggataagcttacagcagtactccttcagccattgcacattggataccggggacccagtggacttgttccaccttcttggatccatagagatgccaatggtccagtctaccttcttatggatgccagccacctttaactcttccaagctgaaggacctgccagctcatactttggtgtgataccttactgtggggcatcttactacgggctggatgggtccagatgcagggcatgcttttgcttgcctggatttgagtctgcagatcttccaggccagctggttgaaccaagtagccacacactgctgccaatccttatggaagtgagtcttcaggatcatgccatccagctgagcaagatggctgcctacaaccctactccacaggagacctgctgagcagaagcaactctttttggttctttttagagtttatatgtcttaaccgtctcttcatgcatactgtccaccttttctgctgtaaccttcagcattgttgtgtgataatgctcacttctgagacattgctggatctgttttcatttaatgtgttatgttttaacttttttcccttgctttttcatatgtcatataattttcttctatatatcgacattttgtataaaagaacagtagagaaaaaaataaccaatttttgcctctagaaaagggcatgttttttcttctatccactgctggagtggaaaggggtcttagtctctctgatgttagttgaaccgtgtctgggctttattgcagtcttagcttcattcagttcaccattggttttaaatatgttgaggataggtcaggactttgggctctgagccctgttgagattctggagatcttattgtcatttcaacaatattctacactatgggagatttcgggattttgtttgtttgtttgttttttctttttttttaatttttatttatttatttatttttttttttgttagacggagtctcactctgtcacccaggctggaaggcagtggtgtcatctcggctcactgcaatctccacttcctgggttcaaacgattctcttgcctcagcctccctaatagctgggattacagacacacacaaccatgtctggctaatttttgtatttttagtagagacatggtttcaccacgttggccaggctggtctcgaactcctgacctcaaatgatccacccatctcggcctcccaaagtgctgggataacaggcttgagtcactgcgcctggccaagatttgtcttctttacagccctcataaagttttcagttgctggggagttctcttcacgttccaggacctttccagagtttctgagcctctagagctgtctctctgccatgccacccacccttaagacttggagagctacagccttacacactcactaaggtccagaatgccttaggagagtttctctaagcgctcctatccaattcttagcttcaggtggctaaattacctaatttttaaatataaaataattagtgtttaattagcttacatagaaaagggaggtttttaaagtttttcttttttattgttgatgtatatttacatgcaacaaaattcacccattttacatgtatattttcatgagttttggcgatgatttgtagtcatgtaatcactaccataattaaaaaacctttttggtcaggcgcagtggctcatgcctgtaatcccagcactttgggaggccgaggcaggcggatcatgaggtcaggagatcaagaccatcctggctaacatagtgaaaccccgtctctactaaaaacacaaaaaattagccgggcatggtggcgggtgcctgtagtcccagctactcgggaggctgaagcagaaggatggcgtgaatctaggaggcacagcttgcagtgagccaagatagtgccactgcactccagcctggacaacaaagcgagactccttctcaaaaaaaaaaaaataacaacaacaacaaaaaaacctttttatccccctaaaaagttctgtcatatcccgcctttgcattcagtccttcctgtaacctccagacccaggcacctctgatctctttgtcactatgattttatttttcctagaatttcatattcattggatcatagtatttgtcttttatgtttgtcttctttcacttagcatattgttcttgagacatatccatgcaggcgatatatctctgctattcatttttattgcgagtagtattctatggtacatttatcacaaaatgtccaaaggttgatggacattttgtgatatccataccatagaatactactcagcaataaaaatgaataccatttcagttgcttccggtttggagctcttatgaacaaggctgcaatgaacatttgaggaggagtctttgtgcggatatagtttttctttctcttggataaattcctaggagtagaatgatggggttgtatgataagtgtctgtttgactttacaagaaactgtcaaatttttccgtctatagtggctggaccactttgcagctgcctcagaattatgtgtgagctctggtagctcgatattcttgccaatacttggtattgtcagtctttttcattttagccatcctagtgtgttatctcattgtggtgttaatttgcatttccctggtgactacagacagcattattttacatccttaaaaagaattggtatgtctgtgtttcccatttttagttggtttgtcctcacgttattgatttgtaagattttttttttttttttttttgagacaggatcttgctttgtcatccaggctgagtgcagtggcatgaacttggctcactgcagcctcaacttcctcgggctcaagcaatcttctcacctcagcctcctgagtagctgggacttcaggcgactgccactaaacccagctaatttttgtattttcggtagagatagggtttcaccatgttgccgaggttggtctcaaacttcctgggctcaagcaatcctcccacctccgcctcccaaagtgctgggattacaggtgtgagccactgcacccagcctctgtaacaattcttcatatattctaaatacattttgtcatatacgttttgaaaatattgtcttccaggatacgggttaccttttcattttctttgtgattcaaagagcaaaagtttttaatttttatgaagtccatttcattaatttgttcctttctgatttgcactttttaatgagctaagtcctctttgcttaactccagatcacaaagatttttacctatgatttctcccagaagttttatcatttcagctcttacgtttagatctatgattcaccttgagttatttttatgcataatgtgtgtggttttgtttggttttgcttttgttttctcatatacatacccagatcttccagcaccatttttgaagttgctatcctttcccattgtatttccttggtacctgtgtcaaaaatccatttactacaagtgtgagcctactgttatatgctgaatagaagtggtgaaagcaaaaagcattactttgttcctaatatgtggggaaagtttttaggatatgaccataaagtgatcattttagccaaagcttatctttttttattattttactttaagttctgggatacatgtacagaatgtgcaggtttgttacataggtatatatgtgccatggtggtttgctgcacctatcaacccatcatctaggttttaagccccgcatgcattaggtatttgtcctgatgctctcctccctttacccctcaccccctgacaggccctggtgtgtgatgttaccctccctgtgtccatgtgttcccattgttcaattcccacttatgagcgagaacatgaggtgtttggttttctgttcctatgttagtttgctgagaatgatggcttccagctccacccatgaccctgcaaaggacatgaactcattttgtcaaatttcactccatttattttgaagctctgttattaggcacttacacatttatgattgtcgtatctttctattgaagtcatccttctatcattttgaaatgtgcctctttttttaacttgaaatctattttatctcatgttagtatagtcagtcctgccttcttatgcttattgtttgcatcatgtatatgttttttccatccttttatgctcaacctatttgtgtctttatttgtaaagtgcatctcttatagatagggcatcttggttcttggtttcttatctgaaaatctctgccttttaattagagcatttacttcattaccatttaatgtaattagtcatatgatttggtttcagcctgccatattattgtttgttttcaattaatctcctctcaatttttgttattctattaccttccctcgactttataaaagtatcaattaatgtattagtttgctaggactgccataacaaacgatcatggactgaggtggcttaaacagtgaaagtttattttctcataattctggaggctagaagtacaagatcaaggtgtcagcaaggctgtttttttctgaggcatctctctttggatggccgtcttctccctgtgtctttacatgctctttcttctgtacccatctgtgtccaaatttcattttcttataaggacacaagtcatatcgtgaggtactggagtttaggacttcaacaaatgaattttgaaggagggggtgggataatccagcccaaaactattggttttataattgcattttaattttgctattaacttttagctatacttctttgcatttttttagtggttgctttaggaattacaatatatatatccctagctttccatagtccacttacaattagtcttgtactacttcacataaaatgttgaaatatcatgtaaaatgtagaaatactgtataggtccacactctcccatattttatgttataattgttatacgttttcagtcaacatacattataaaccgaagagttacaatttttttaaacagtcatatgtatttttttaaaaaaaaaaaaagggaaaaagcaaaaacatagtctttcttatttatccagctatttaacatctgcagtgattttcattcttttctgaggcattaagttttcatttagtgtcatttctctttagcttcctttagtatttcttatagcacaggtctgctaaaacaaattctcttcactttcttttatctgataatatccttctcccttgaagaatattttcattggatatagaattctgggttgacaggatttttttctttcaacattttaaagatgttccgctttcttctgtcctctgtagtttctcatgaggtatcagccgttaatcaaattattgttcccttatacataatatgttgtttttttcttgttgttttcaagatgttttcttgagtccaacttcagcatgacctttgccatctttactcttcttggtgttcatggagcatcctgcgtctgtgaatttgtgtctttcataaaatttgagacatgttcagctattatttcttcaaagtttgtttttgcctcatttttgctctcctcttattctgcccatttctcccacaagatcgacttcaaagtgtcttttgaattacttgcaaggggagggctagggaaggcttatcaaagcccagattcttgggctctacctcagacttattgactcaatgtctggaactgagactcaggactctgtgctgtagtaagttccccaggtgacttttatgcaccacaagtttgagagctcctgcacaggactttatgggcttcaagagcaggaccatatcttatttatctgttggatgctcctaaattgctctgtagtacctcactccatgtcttatacgtggaaggtactcaatatgcatgtcgatatgcatgtgatatttgcattaatgcataggattgtttatcctccctacttcaaaaggcaactcttatgcgagtctttacctcatcaacaggtcttaaagttgaggtggttgtagttcacattcaagttaattaggactcctctggtttcttattatggaaatacaactcaatgacttaaacaaaactaagaaaatgtgttgacccatgcaactgaaaagtccaatgattgtaccagcctgggtcacagctgaatccagggcaccaacacaacatcctagtaccatctctcaccatctctaagctctactttcctttaggttggttttattgtcaggcaggcatcttcccactttgagataaacactgttgtcaacagttctgagctcacatggttcttacacttgtgttctcaaagtaaatagagcaacacctcctgggcagctctacccaaagccccagaaaggactcttattggcctggctttagtcatgtgtctattcttcaaccaatcactataaccagggagatgacttgctctgattagtcatctggagtcacgtggtcacccctgaggtaggagaggcagggccatgaaattgacagcccctatggataaggaaggaagaattccaagcacacaaagcaacagatgacttctaccacaatcttcaacataatggatgtaaactcctgttcatgcctttcaacagagaaactttagaaccatgtttgtgaaatggacccttttttctccagggaggttagagcaaattccataaagccagtcattcccaatcttggctataaatcaaaatccccttggcatgcttcctaaaaatacagatgcctggacccgtcctcagacctaaagaagcagaatctgagtggttgtgattagggagggtatataaaattttaggtgtagaatggtaataattttgcccaggcagcctatatgccccctttccatttcccacttttccttctgaaactcctttcaccaggtttcaatccatgtggttgggggataatactgtccccctaccaagaatgagcacataacccagacctgattgatcagagaatttgatccctctgtccatagcaattggttcagggataggcattcagtgcaacctgagccagtgagaccgaaacccagcattttgttggaaattttgggaaacagaagccctcttttttgttggaagcactagccatgagggtaacatgagcctacagtggcccaggggccaccacatggcgaggtcccccctaagagtaaagctcagtaggcaaagtagagcccaaggggaaagagatgattccagagattcttgaggaagaagcccaagaacgggccatcagacagaagacccagaaagcagacaggaccacagagaaagcaagccagagtcctgaaaacatcctccatggcctgactctcctctggccttacagttagttaggagaccctctaacctccctcgagagaaaagtcagttcgagttgtgtttttctattccttacaaaggaggtgaggcttcctaagtctttcatgtggttgaacatgttccaaagtttattcattcattcaacaacagttaattgagtgtctactatgtgctcagcactatcctacacactgaggatacagcaataaataaaacacacaaactccctgttctcttcatagcccaagtttcttttaaaaagcaatcatgttctctcatttttaaaagtatcacctttactttgaaggccctgagtaagtatgtggctgaccaagcccttgcaattagaggaacattaatggcgccttcttcctgacctgtgcattcttcctcccaaggaatctctttgtccacttgtccatttccatttggcaaggcctttcccttgagggagatgagagccatggccagattctgagtagaggagggatgtggaattggaccttggacaagtcacttcagctctatgagcctcatttacctcatctatgaaataggggtgaatcctggtaggcaaacaccacagtaataattgctgcaggcaagatccacccgtgaatgctgagattagtgggtgaaagtttgtggattaacaggaaattcatgtagtctcaaagtatcacctccaagatatttattcattacaaaagacaaccaagtaactttacgcaagagacacccagtagatgccaccttaaccaagtgatcaaggttaacactaccagtaataagaaatattggcatcatgtagcccttcatgtgattacctgaggatacaatatcacttcttgccaaaaaatgctcaacgcaaatctaatcatgagaaaacatcagactagcccaaactgcaagacattctacaagataactgaccactacttatcccaagagtcaaggtcatgaaaaacaaagaaggcagataagttgtcacagactaggggacactaagggacaaaacatctcaacgcaaagtgaaatcctggattggattatggtacagaaaaaggacatgagtggaaaagctgatgaaatatgaataatgtctgtagtttagttagtagtattgcaccaacgttaattttcttggattaatgtttgtgccatggttatataagttgttaagactggggaagctgagtgaagggtaaataagaaagctctgtactattcctgcaacttttctgaaagtctgaaattatttcaaaatacaaaattaaaaattggactgaataccagttcttactgtgtaaggatggtatgcagattaagcatccatcaagtcctcagcgcagtgctggataagcattctgtaaacaatagcaagcattgctgcgagcttcatagcaagcattgctgcaagcttctttacatctgttatcaagcacttactcatggagcacccacacgctcaccgctgcccagtggctttctctgtctcttgccctcatcagtgaattctctatttgggactgaataaagaggattctgcaaatcagtcctgaaaacaagagtttaaacaaaagcaaactgtactactctgattacaaaacagaaaccaagagtgctcctgagtgctgaatggaagggactcatgactccgcccctccacccccggaagcagatgaagcagatgacagaatttatttgaactgactgctgaatggaacagactcacgaccccgcccctccacccccggaaacagatagcagaatttacttggaaaggtcttagaggaaaacgaataaggcatctattcttggattgactagccaaagtgtcgacgtcaaaagcgccatttttggttttatccagggtctcattctcccctaaatcaatggtctgcaaacttctgatcaggcacacatattaggaaaatattttgaaacaattcctctaatgtttatgcatttacttgctaattatatacatttaccatgatattaacctattatgtaggtggtaaagcatataaaaggacagctgtaaagaggaagtgataaagaagaaataagtgatactttgaaaaaatttactcagtgatgtaaaaaatttccttactctcacttaaggattattgttgtttggatatcgaatatcctttattatttttaaatttttggtttattttatatggtttgaaattgtgcagtatggtttatatcaatacttgatttttatgattgtcataaatgaaaaactaacctcatagagctatatcttccaactggatgaagggtatcacttgctatacctatttttaaaaatgctgttcatcttccaattccatatagcaattttgcaaaggtttttgttgaaatttgtctagttatttttatcttccctgaggttaagctgttgttgaaaactaattaaaaagtgttgaatttttgcacttttagcatgagtttaaaattcactgacactgaaatgctaggttgagataattttaagttatattagaaaatttggtttccaggactttaaagtgtgtgcatattaaagcatttatatagagaatttacataattttgaataatgtaaatatgtcaacaataattccttaacaagaatatttccaaacatctgtttttaaaatgttttctccaggctgggtgcggtggctcatgcctgcagtctcagcactttgggaggccgaggcaggcagatcacctgaggtcaggagttcaagatcagcctggccaacgtggtgaaacaccgtctctacaaaaaatacaaaaattagctgggcatggtggtgggcgcctgtaatcccagctacttgggaggctgaggcaggagaatcacttgaacctgggaggcggaagttgcagtgagctgagatcataccattgatctctgacctgggtgacaagagcaaaactctgtctcaaaaaaaaaaaagaaaagtaaagaaagaaggaaggaaggaagaaagaaatgttctctccatagcccaagtttcttttaaaaagcaatcatgtcctctcatttttagaagtgtcacctttactttgaaggccctgagtgagtatgtggctgaccaagcatttgcacttagaggaacatgaatggcgccttcttcctgacctgtgcattattcttgccacctcctcccaaggaatctctttggccacttgtccatttccatttgggaagggttggttctattcaatgtagcatggccacaaagttgtcatctggtcctccctggctgtgccctctccatggggtcagagtcaacaaggctaagggactgtgcctatccacagcccacatccaatctcccagaccatgcaccctaagatcctggaattttctcccagagctgtgggagactcttccccagggctatcctctgtcctcctaagagcagattacatcccccatgtacacaccctgcagtccaaggagaagccaaagggtggtcagaaggcttggacatgagctggcaagtacaaacacttgtgcacaagaccttcatgatgtaggatggagctggagatggaatacaaaagggaagtgggctatgggccagattctaaagagttctgaatctgagcctggctcaccaggtcactgtgaagccatgtttgcaaaaggagaaagctagcacatattttattgaatattttgatatttagtcatatggtaagtggaccttttgtactcttgccctgggtcctacaaattgattgggacaggcttgtcacctgctgttgtctttcaattgcctcctctccgtgtgcagccacctctgaaggtcatttgatgagccttttcttatctcatgcaagtgtccagcaaactctcatttgaactcttcttgcaaggtctctaggcagctcctagcttgcaataagatggtgccccaggatttatactctcccaggtagagtccacggtgctgactgatccagtgaatgctcagttgggtgtgaatctgaaagttcagatctaccaataggagatgatttgctttggggaactgggaaagggaaacgttctcagctccttccaaaatccaaaaacccatttcaagggctgctgctctactgacttccgcctgccaatgtgaaaggtattccaaaaatgtggaggggaaatgaaaagctgtctttagaatggagagggtagaccagtcatttctaagtagcatcagttaactgatgtaacttcagcgcatcacagaagtaaatgaatgaggtaaaatgttttgtttacaacctctcaccattggaaaactccagctcttccttctggatgtctcaaacaccttgaaagccccaagacttgtgacacacaatcagagggggcaccacggcccactggaatagtaaatctcagtaaagcttaatgtcttttgctttattttagattaaaataatactcagaagtgaaagggcttatgttgtcttctttggtgtcagtggataatccgacttactctaccttggcaatactcccctaaattatgaattccaattggggtagctaaaaagcctcggaaaagactttctgctaaaatagatgccagacaatcaagattcctccaggaaaagaataaaagttaatagtacatgttggtcacatagttgaaaagaaatttagagaatttcaacttctgataataaatgtggagaaatagaggtagggtcacagaagaaagaggaattgcttagaagtcaggagactgagagccagcttctgttcatccccttcctaattgtgtgattgtctcagtttccctatttgtaaaatcagagggttagacttgattctctccaagttgaaaactcagatatgcatcaaatttagggctgtacactcaaattcttatgggggctagggagtaaagataaatgagtgacaggggccaggtgtgagacaataaggagtggtggagactggggtgaactagagatatagcccctactcagctgcagccagctgattccatttaggcagaaatataagcctagtgttgtagtgttgacagttctcccacattttttagaagtcaggaatccagatattatataaaatttccatattattaatgatggcatttatttcttaaaaatcatttttgaaacactatgctgcataaacaaatctcccacgaaaccagtttgtgacccattgcttcagaagacttcaatgcattaactacatttcaacttcattggcaacaattgctggaaagttcttcattttgccctgtcctcacacctttatatttacttctgccgaagatgtttatttgcctgggaagtggttccctaacagaaacatttgttttaactgttgtggcaaatcatctatttgttgggagaggtggaaaagaacagctaagacctttttcccccacaaacatttctttaggccagcttacgaaagcctttgctgatcggtttttctctgtaacagggcccagcattgtcttgggatgggaagatgcccatctgtgtggatggggtacaaatttccatcccaacactgcagatccagcacctgatgaggagccctgaataatcacagtggaagttccactcaatgctaacacttagcagccatgtgaagactcataaccctctcttcctctttctctcacccatctccattagctgggcctgcgtcttggttgactttgccgtatttatgaaacaatatcaggttaattcctatcctctttgcttcacatgatttcatgcaaataatcgctgcctacgtgcacatttcaaaagggacccttttaaaaatttgatccttcaaacttaactttgccctccaagcattccagactcacccagggcctcaatttttaatatatttgcacagaaaattatggaaaaaatggaatctaaacaatggacttgatttttaaaaataatcaggcaggaattaatgtttcaaaataattgtctagaggtgattcaatttcacatgctctttaaatatgtatttttcagtgcactatggcttgaagggatgatttcaaattagtgtatatagcaggctgtgaatcataaaaactcttatagttaagtttttcatttctttgctgcaaaacttcatttcaaaactgaaattttaccttcctggtaaatctcctttcctcccctgccaaaataattttatcaatacaaaaataaaggattggcttttaataagtacaacttagagattttgtggcaggcagcattcaaagatgctggtgttggccaggcgtgtagctcatgcctgtaatcccgacactttgggaggctgaggtaggaggatctcttgagcccaagaattcaagatcagcctgggcaacatagtgagatcccatctctacaaaaaattttaaaaattagctggatgtgctggtgtgcccctgtagtcccagctactcaggagggtgaggtggaagacaggaggctgatgtgggaggatcgcttgagcccaggaggcagagactgcagtgagccacaatcacgccactgccctccagactgggtgacaaagcaagaccctgtctcaaaacaacaaaaacaaaaacaaaagatgttaatattaatgtcctggataattccttcttctcaagcgtgggtgacacttctgacttgcttctggccaatagaatttggcaaagacaataggatgtcacacctatgagtgtatgtatatacaatgtaaaatgttatatatgtgatttttttaatatttagggacagggtctcactatgttgcccaggttggactccaactcctgggctcaagcagtcctcccacctcagcctcttgagtagctgggactacaggtgccagactttttaatatataatcttacgtgtgtgtgtgtgtgtgtgtggtgtgtgtgtgtgtgtgtgtgtgtgtgtgtgtgtgtatgaaataatcttgcattagagtaagagagagattctggccttgaaaaagcaaacagccatgttgtgagttgcttatagggaggaccaagtggcattggcaggtggcatccagggtctgagggcagcctccagctgacggccatgaagaagcagggccctcagacatacaaccaccttttgtacctgcagactggtaaacaggaaaaggtgaaacgaggaaacaaagtgtgccagcaacctacctgagctttgaaatgtgttcttccctggagaatgcagcctggccctatcccgattgccttctggtaagaccccaagcagaaggacccagttaagccatgccagtgctcctgactcatgacaactgtgagatactaaatgtgtgttgttttaagctacttagtgtgtggtgatttgccacaccacaacagaaaattaatacaaaatttatttggaaggactattgcaaaatttatcaaattatagaattttaacagagagaatttttagctcaacccttttgtttaacgtgtgaacaactgagaatcagaaatggaaatagtcacagatcaagttagtgataaagccaggaacaagtttcctttggccctttctgtgatatcaagcttcttccctgtaaggaaccactggtattgactttttctctttttctctctctttctccatatatatacatatatatatacacacatatatatatatgtatatatatgtatatgtatatataacgatcactctgtctctttttcatatgaatacatttataaatatataaatttaaaatataatatatgtaaatacatacatatattattattgttgaatcttcccattaaaaaaaggttgaacgatttacatatctcccaatacttgatgggcaaatccatttcctcacaattgcacacaaatctgttattattcaccttttcctgtttatcaatctgcaggtacaaaaggatattttggtgtgttttattttagccattcctaatatttaagcaggctgaacaccttgcttaatgcttattggtcagttctatttcatggtttattaactgcatgttcttactctgttcactgttatactgggttgtctgtcttccctattgatttgtaagaattcttgataaatgtgtcctgagttattagcagtttatgtggagttaggtgtggtggcttatgcctgtagtctcagcactttgggaggctgaagtgggaggatcgttcgaggccaggagtggaaggctgcagtgagctatgatcctgccattgcactctagcctggacaacagattgacaccccatatgtaaaaataataataataataataataataaagaaatagtttagctgtttaaatttagcaactgcttcttctaagttgttccttgtgtggttttttttgttttgttttgttttgtttttgtaggattcacttggacatgcaggctagagtgcagtggcacaatcataatcgcagctcactgcacccttgatttcctgggctcaagccatcctcttacctcagcctcccaagtagctgggactgcaggcataagccaccacgcctggctaatttttgtattttgggtagagacagggcttcaccatgttgcccaggctggtctcgaactcctgggctagaacaatgcacctccctcggcctcccaaagtgctgggattacagcgtgagccactgcacctggtctcccttgtcttttaatttagtttctgagataatttgctatgaaaaaagttttaaaccttttgtagtcacacttatcaatctctttcattatggatttggattttttggctgtctgattcgtttcagttgttgctgcttgatcttgctcagaggaggcctccccactctcgtgttacagaaatagttccacgctttctcctagtgtctttaggtcttctttcttttttaaaatgtgtactgtttattccacatggagtttgtttttatgactgaggtggggtaagaattaacctttcccaggagagccaattgttccaacagcattgaataatccatgccttccccaactaagcaaaacagatgtgcataaatacgtgcatactcctagactcatattctagtacattgctctattcatctctctttttttttttttcctcgagatggagtctcgctctgtcacccaggctggagtgcactggcacaatcttggctcactgcaacctctgccttctgggttcaagtgattctcctgccccagcctcccgagtaactgggactacaggcatgtgccaccacacccagctaatttttgtatctttagtagagatggggtttcgccatgttggccaggctggtctctgactcctaacctcaggtgacccacccgcctcagcctcccaaagtgctgagattacaagagtgagccaccatgcctggcctatttggtctctttacgccaacacttttccattttaattatcatagctcccctatctatcttgatatctggtcaggtaatttgttattcatttttaaaatgtccttgtcagatatttcctccttcggatgaattatagaaccagcttgtcacctttgaaaaatcatttggggctcttcctctgccatttttttccctttcccctttgcctttcttcttttctcttccattcctgatcaattcaatgcaaaagccattcaaaaaatgataagcacccatggggggcagtgtccaacacagaaaacctgacaccccaggcaggaggtggcttccccacaggagaagcaggagtggagcctggcaggggagtcagagtcctagggagtgaggagggtggctttgcagggatggtatcctgcgcagggtgggtgcccattgcctgagagtgaggaggtgggtatgcctgctggtgggtggcagctcctggacaaggtgccagaaccccagcagggtgtgaggtcagcttctgaatggaggatggattgcaaacaggggcaatgagcaaattagtaaatatctcaaggatccagctttctcacgtttggaaaaagcagtactaattatgtaaagggagaaaacagagtgaaccctgaagcgttggattggtattgcactatcggtctaagccagggctgacttcatggacgtgtgatcagtgcatttgcatatggccccgtgtcatgtcatacactcaggtgttcatgctgcaccatcactgtcttgaaattcttaataacttaatctttgaatttgtatttcgtaagtcaagtctcatgggacagtgcagcatgcacaaagacttggagtctgagctcagcagcggtcccatgtcccaccatctccctgcctccccaggatcagggtctcagccacctttctcaattcccacagttcctcagacccctctcagcctccttgttcccctccccacccagcaaccactgtcatcttctgccttcagtgcctacagcgagcacatctataccacgcccacccacaatccaggtacttagccgtgtcctggctcagaggttgcaatacccctgaggatgcccacctgctatgggttagaggagtgggtcgaggggaagagtggatgctttgcttcattttcttgccccagcagggacacagcacatcagtctggtgactggcaggagagactgcagctggtaggctacacttgctctgagtcccagcgtagagtccctgggcacctgtgagtctctgccttcaccccaggagtatcctcatgcacgatgcgaaacagcaataaaaaccactgtgacaaatccagagggagaccgtggaggtaagtgaagagcttgtattttagtacctttattggctcttcattcctgctttttgaacaaggtcccccatattttcattttgtactggaccctgaaaattatgtgccagtcctggtataaactcatgattttcaatatatttaaattgattcagaaataaatattgatgtaagtgtatgcctgcatatatgtgtctgtacatctgcatgcacctagctctgtccacggagagatcctgagagtggccgcacagtaggaaaaatgaacacacttagcacctggaccttgtcttctaaaaattattttatttatttatttatttagacaaggtttcactctgtcattcaggctggagtgcagtggcacaaacacagctcactgcagcctcaatctcctggactcaagcaatcctacctcagcttcccatgtagctgggactacaggtatgcaccatcacacccagctaattagcttattttttgtaaagatggagtcttgttttgttgcctaggctggtctcaaactcctgggctcaagcgatcctctcaccttggcctcccaaagtgctgggattacaggcatgagccgccacacctggccagtttctaaaaattattttctgctaaaaagaactggagatttttggagaaacagctaattccagatccagggcaagatgagtagaagacaaacctgagtacctgttcagccaaaaaagaaggaagtaatcaaagaatgatggggacatggcaagaggacacggaagccagcaggaagaggctcctactggccacacaaaacactttttaattacaaaggaagaaagagtaacttgatagtggagaagcctggcagacaccaccttaactagaatcagagttaatgtcaccattaagggaacaaattgaaaacatgtgctatgaagaacgcagcatcacttcaatggtcttctcgccaaagacgcataacctgaatctaaaaatgagagaatgtcagattaatctaaatgaggggcattctgcaaaataactggtatatcaataatatatcatataatatgtaatactatatagtatacacatatatactatactgtaatagtatagtatttaatagtataatagtacagtattatatagtataatatactatataactatataatactataatagtatagtattacatagcataacatgctgtataattatatagttatatagcatattatgctatgtaatactatatatattatagtattatatagtatatgtataacagtagagcaggatattatactatatagtattatatatactacatattgaatatataattgttttcttttgaaatatatattttatatgtatatatgttttcttttctaaaatatatgcttttccagatctttttaatgtacaagttatttcaaatagtcctctgaatttttctttttcttttttttttttttaagagataaggtctggctctgttgcccaggctgtagtacagtaggctcaagtgatcgtccctcctcggtctcccaagtagctggtactacacacaggcaacacgatacttggctaattgtttttattattttttggagaggcagggtcttgctatgttccccaggctggtctcaaactcctgggctcaagtgatcctcccaccttggtctcccaaagtgttgggattataggcatgagccactgcccccaacctagtcttctgaatatttacatgggatcgagtttcaacatgagttttggaggggacaaacactcaaaccagagcaatataaaagccacttattaaagatgtctttctgtcacagtggtcaaactgataccttcattaattcagtcactgaatgctgaaagagaattctaggtaaaggaagaaatcattccaatttgggagatcataaaaagattattttgtttgatcttcccaataatcttgtaagaaggtaagtttgcatgttggtatttaactgccattaatgttgtaggttgctaaaaaatgcttacggtacagctatttttccccctttgggatttgtctacgctgttggagagggcaggccaagggattcagttctgctgaaggaaccggggaaaaaatgctgtccaaaccaactggggttttggcaatgaatgcacatttgttcaccagttgagcatttgtttagattcctctgttttgaaaaattaagtggttcagtattttaaatttgttcctaagcccagtataatgaatgacctttcatcttcttaggtcactgaaaagaattttcttgtgtttgtggctaattcctcactggcagaggcccagacaggggacaggagggacgctcaggctgcttaagtcaaaaataaacacaggaggagggaaggaccccgaatgtcccgtgtttgttcattttcaatcatccacactgtcatgtgtgagtttgggtggttttgtatacagaataagctgtacacacattctaggaaataattttgaatgactaaagttgcaatttaccaaaccttgttttcctcttgaattttaatgtttccttttcaaatctgtgattccatttataagaatagaataacaaaaatcagtcactgtgtttgagaacgtcattgattaatatttggtctcatttataaacgtagccttcaaacatttaacatttaaatgctttcaaatactttaaactgcatttctaaatttgatattctggactttgttttcaagtacttcaactgtccaacacttctgctttcccaagtaagtacttataagtctaataaatcacatttctacaaatcttaaactcttaaatgttccagtgggtacatgttagcttagtaagatttctgctttaaaatggcacatttaagcaatggtttgattccattttaaattacgattaacaagtttgaccaacatgttgttcttatagaccgaagcctcctaaacataaggctcttaaagtatgtaaattgttaaatataaattattcctttttaacaaaaagaatagtaattcagtgatgatgctgaatttgtcaaatatgtccatgtttatttctgaatcttatctctgttacacatgcttacagataaaatcactttcccatggaggacattcctataaataactttaaatattcctggagtttaaagatgcttccctcctgggagattatcatatttctgggtactcaaggttgcttccaactagactttttaacctggggtttgtgaatagaattaagggggttcgtgaacttggatggaaaaaaagtatctctattctcaccaacctctaactgaaatttggcattctcttcacatatgaacataaacaacaaaccacaattgtgttaccaggacctgtgactctctcaccaatagaaatgacaggttttgttttgtttgtttgtttgtttgtttttgagacggaatcttgctctgtcacccaggctggagtgcaggggcgcaatcttggctcgctgcaacctctacctcccaggttcaagcgattctcctgcctcagcttcccgagtagctggaattacaggtgtgtgccaccatgtccagctattttttttttttttttgtattttttgtagagctagagttttgccacattggccaggctgtcctccaactcctgacctcaggtgatccacccgcctcggcctctcaaagtgctgggattacaggtgatttttatatcacattatggttgttgtatctcaaaataccttttctaggcagcactaactttaaaattagcttgctgctagatcctgttatttagtgcattaatgaagaaactcacatggccatatcacaatattttcatatttgtattcaccatataattgaagtacaataaactggaaatacttaaagtgttaaatttttttaccatttttgacacatgcaccatgaaaccatcaccgcaatcaagacactggacttttccgtcacccccactggtttctctgtgcctctctgtaatccattcttcccttcactcccacccacaggggaccattgatttgctttgtgtcactatacattagtttacatgtttaagaagtttacataaatgggccaggcatggtggctcacatatgtaatcccagcactttgggaggctgaggtgaacagatctcctgatgtcagaaattcaagaccagcctggccaacatagtgaaacctgtccctacaaaacatacaaaaattagccgggtgtggtggtgcaagcctgtagcccctgctactcgggaggctgaggtgggagaattgctggaacccaaaaggcagaggttgcagtgagctcagatcctgagatcacaccactgcactccagcctgggtgacagagtgagaccttgtctcaaaaaaaaaaaaaaaaaaaaaatttttacataaatggaatcatgattcttttttggtagggaaggttctgcctttttcactcaacatcatggttttgacatccatctgtgttatatgtgtatcaatagttcattcttttttataatttaatagtcatttattgcatggatataccacaatttgtttattcatttacctgctgatggacatttagactgtttttagatttgggctgttacaaacaaacttgctgttaacaatcgtatacaagtcaagtctttgtgcggatttgtgttttccttcctgttgggtgtcaaataggtgtgtcagatgacagagggatgtgcaactttttaagaaactgccaaactgttttgtaaagtggttacaccatttgacattcccaccagcaatgaatgagagttctagctactctacatcttgccagcacttggtctggtcaatctttttgttagccaatatattgaatacacggtgacattttattagagtttaatttgcatttccttgattattaatgttgagcatttctttatgtgcctattgaccatttgtatatcatctttttgaagtgctggtttgaaatctttgcccattttaaaaattgagttaattgtcttcttaattgttgagttgtaaaagttcctcatagatctgttatagattccttatagattcagaagatatgtctgatacatcacatgtctttgatactcagaacatgtacaacacatgtatcagacacatcttcatatatctgttatagattctgttatatggatagattccttataatatagattccttatatgtgtgtatataatatgtgtaggtgtaatctcagctactcaggaggctgaggcaggagaatcacttgaacctgggagcccgggaggcagagattgcagtgagccgagatcgcgccactgcactccagcctgggcaaacgaaccagactctgtctcaaaaaaaaaaaaattataaaacttccagaagaaatcattgcaacctcggggtaggcaaaggtttcttcgaacacaaaaagtacaaaccatgaaataaaatattgataaactggacgacatcaaaatttaaaactttcgttcttcaaaagacaaaattgagaaaataaaaggcaagccatagattggcagaaatctatcacatatatcagagacattttcttatatctgttatagattctgttacaaggatagattccttataacagagattccttataacagaattggaggttagaagcaagatggttaagttggatctctttcactgtctcagtcataattttgcaaaggtggttccaggcagagagaccatctgtcccagtttgctggggacaatcttagtttatgctttgttattaatgctccttttgctctcaaaagtgtcccactctcaaaaggtctctagacctctgaccttgagggactcctatagtctcttcaggtactccttacgtcttcaggaccacaaaatcttctagaatttagaacaatatctgttggggttctggggatctctgatgtctctcagtccttgcttccgagataattccaccgatgcacgctgagatcagttgactccattcaccatccaagacattatatccagctaaaagccagcaaaaagacaagacaaatgtattaaaaagccttctggcttcattctatttgtttttactctcctgggaaaagagaatgcaaaaagtgacagatcttggaaggaaatggccaggaggtgtagagattcttgtgcttagctgagagggccagcgtggagctgggtgaggaggtcacagaggaagaacagttagaggagaatgctgttttaaacagggtggtcagggtctctctggggtagaggcatttgagcagagacctgaatggagtgagggtgaaaaccataggactatgtcaggaaggggtagtgcaggcataaagagcagcatgcctgggtgtctcaaaggtccctcttcacatgagtgaattaacatctcccaccgaacactggtgatcctgaaattctgatgctctgccagaaaatgcacccaagagttgatttcccattgttttaaatgggaaacattataatgcatgacaggtcaacccaagcccccaacaccccaatcctcatggcctaatcacttcttcaagatcctgggctcaagagatcctcctgccttggcctccccaagtgctggcccactttcttgataatgttctctgcagcaaaaaagtttttaactttgatgaagtctaatttatcttttgtttgtttgtttgtttgtttttttgagacagagtctcactctgttgcccaggctggagtgcagtggcaagatctcagctcactctcttaaaatagagctaagcacttaaaatgctgtcttagtctgtttgctctgccataacaaaatacctgagattctggtattttataaagaacagaaacttatttcttatggttctggaggatgaaaagttcaagatcaaggtgccggcaggtttggtagtctggtgagagctgctgtttgcttgcaacatggtgccttgttggtgtgtcctccaaaggagaagttgaagcaagcctctatttatttaagaaggacctgaatctcattcacaagggaggaaccctcatgacctaatcacctcttcaaggactcactttttttcttttctttttttttttttgagacgaagtcttgctctgtcacccaggctggagtgcagtggcacaatctcggctctctgcaagctccgccgcccgggttcacccttttctcctgcctcagcctccagagtagctgggactactggcgcccgccaccacacctggctaatttttgtattttttagtagagatggggtttcaccgtattagccaggatggtctcaatctcctgacctcgtgatgcgcccacctcagcctcccaaagtgctgggattacaggcgtgagccacctcgcccagccaggactcacttcttaattccatcacattggccattaagtttcaactcctgaattttggaggggacacattcaaaccacagcacatgtctaccagtaagtatcaaagcagtaaaatgtttcaaacatagcttcctgatcaccaaatcatcaggaaagttttcaacaaataattggtttgtctgtggcaacacagccacatctgattgcatgtccctttcattgctccttagtgtacttttctaaatgtgattctgatgttctctcagtggtagttgacatgctgcttttcctgcatggtgttttgatggagatgctaactctaatttgggggatacaaatatcagtttttctttgtaaatattcatctgataattgtgagaaatgtgccttctatgaagtttgagtattaaaaacaaagtcattttattggaaaactacttactgaagagacatttgaagcatccctgtatttgtctgcttgggttaggaaggacgtgagatttctctctctctgtctctctctctctctttttttttttttaatgtttgcaaaaagcccctgcccatccccacatacacactgtatcataaactgccttttttgtaaagactcatgagaaaatttctctcctgtatcaatatcaggcaaaactctgatttgcccaagtcatttggtttctttctcatagaagaattaagaatcatgaacactggctgggcacagtggctcacgcctgtaatcccagcactttgggaggccgaggcaggcggatcacctgaggttgggagttcgagaccagcctgaccaacatggagaaaccccgcctctactaaaaatacaaaaattaactggtcatggtggtgcatgcctgtaatcccaggtactcgggaggctgaggcaagagaatcgcttgatcccaggaggcagaggttgcagtgagccgagattgcatcactgcactctagcctgggcaacgagagtgaaactctgcctcaggaaaaaaaaaaaaaaaagaatcatgaacactatggagcactttgaaatccatgattcttaatcttgactctgcagagctttgggggttccttcaagacctttacacatacctacaggagaaaggggtgaggcataaggctgtggctgggaaccctcacctcctttttccatactgaacttctatacatactagattttaaacaaaggaaagtttgaaagccactgatgtaactgatcacatttctgtccttgcagtggctgcctggaagctcagcatctaattctcagttctccactgacaagtgtccaggaccttctagctcacattttgtgtgcaaaccttaccttgactttcttttgttttctttcctgtttccctgttgtctgcttttcttgttttctttattctgctgccatatatatggttttatatgttgcctcaaatcctttttggaaagagccaaggtttaagtgaatgtattttaaaaaattgaatgctttttctgtagaggtgacctttgcaggtgggaaaggaatatgtttagaaaaaaggcatgatttgtagaattcacatgtgtgtttgtaggatatgtatatacatatcctacaatgaatatacatacattggatatattgtgaggttcatagttttcaaaattaatgtgtttttctggctttagagggcatttacttggaagactggagtgggggaaatgtgttttactccaaggtaggcatgactgtggactacaccacaaagaatctgctgtatggcttagcactttcaaattttgtttgggatcattttgctggttgttatcaaatgaggacaaatacttaacaaagagatagcaagggaagaaagagacagaaagggggtgcttctacataggaaggtggctgaattttcagggtcttgaattagcattgggggcttaagtcctatcagcttctgctcatctgctgtgactctgtggtcaaggtctcactctcccaaagatagggattctcttcctctgctgtatattggaatcacctagggagctttaaaaaaggatgatgccggccaagcacagtggctcacgcctgtaatcctagcactttgggaggccaagatgggtgggtcacctgaggtcaggagttcaagagcagcctggccaacatgaagaaaccttgtctccactaaaaatacaaaacttagctgggcgtggtggcacatgcctgtaatcccagctacttgggaggctgaggcaggagaattgcttgaatccaggaggtgaaggttgcagtgagccaagatcacaccattgcactccagcctgggcgacagagtaaggctccttctcaaaaaaaaaaaaaaaaaaaaaaaggcagatgccacagttccaccccagagtctggtttaattggtctaggatggggactcagcatggagatttttaaaagctctccctggagattctgtgcacccagagttgagaatcacagcgctaagagaaggaaaaataaaattaataagcacctgcctcctgcttatctctcagggtcgttggggtgtgtctgtaatttatgaaataatgggccagattctggggaaggaataaaatggtatgaaggaaatagattaaccctttgcattctatagggtacctttggttaacaagtgttcaagatttttccccatgagccacaggaagaaacatttcacatcctgaccaaagatatagatatagatatggatatagatatagatacagatacatgtgtgtatatatatatgtatgtatgtatacgtatatatgatatacgtatacatatatacatatatatctctccattgtaaattgaaaatatcctaagttcaaaatgcatttaatacgcctaacctactgaacatcatagctcagcctaacctaccttaaatgcactcagaacacttgcattacctcgcagttgggcaaaatcatctaatacaaagcctattttataatacagttttgaatatctcatgaaatttatcaaatattttgctgaaagtgaaaaatagaatggttgtatgggtatctcaattgtggtttctactgaatacacatcactttcacatcgtcataaagtcaaaaaaatcattaagtgaaaccatcataaattggggaccatatgtatacatttaactatatataggggatcatatgtatatatgtaactatatatgtataggtatgtatatatattcttactgcatacaattcacttgatatttcctattccagtctattcctttaggaaaaaaaaattaaggttcacaggccaagacaaattaaacacctctgaaggtcattaagatgctcaatttataatgacttggagcacttagcaaagatactatgggaagtgaagctgtgtgtacagtaataatatttgttgagcaattgctagtgccagctgcagtcatagtagaaagtgttttatgagcatgagctccatgaattttcacaataatagtataagatgagtactgttattttcactttagtgatgagaaaatcaaggccaagtacatatgtacattctgcctctagaagacagaagcagagccatctccaagcctactgcggcaggcccagagaagagaacaaccatgtttactgaatacatttgcttctgtctgaagtttggggagtagaaagcggagtaagctatgaccagaggtgggtctgggaatggtgaggcctgatacatgtataatttgcagcccctattcaagaaaaagagtacaaaattatgagtccaagattagataagaaaatgattatttctttaaattaagaaaagaaatcacaacaaattcaaattttaagaagctgaaaattaccacaaacatcacaaaattcccaactcaactttcctccaaaatgccagcagccacctgacaccaccctactcaagggcaagttgggggtggggaatcggagtggaaagacagcggtgtctacggcctgcagccaaatgtccaaagcaaaggacttttgtaaactttacatcaacaagccaccatctgaacacttttctaagtccccttagaaaggggtccaagcaagtcaggggcccaagaacttaaccttcatcagctcctgtaaacttacaactggaattgaagactgttacggctcaagagcaacggctttggagtcagccaggcctgaatttcattcctggctcagccactttctgccttctttgagcttggacctgctcatttgtgaaatgagtgtgctgacagcagctaccttggggtctctcttggggattacatgagataaggaagagttgggcattggatgagcttaaggttgcaaataaaaatataggacccccggttacattggaatttcggagacaaaagaaatactttttaaatataagtacgtacaaccaatcgcataagacatatactgcaactgattcctcgtttctctgaaattcaaattcacctgggtgccctgtcttttactgcacttaagaaatgacagtggttgatattgcttttggattgaagcatcctgggtgtcccacggtggaattcatagacattagagagtgggtgacgggctaggaaaggctgcatagactccaattaacacagttcattgccagggagactaaaaggggggtggctatgagaggatggagtaagtggggtgccttgatttgggcatgtaggtggagggggctatacctctcactttcactaaaccagttaagctcttgagacctcagtttccttagctgtaaaatgggtgaaacataggggagacccctgaaccgttctcacctaaataccacaccaatggcacttcctcataattcagatgtcacctcctcagagaggtcttccctgactgctctagctaaaattaccgcctctcctccactccccaacagcagatacatatattatttttctccctgtaactctaactttctgaaactgtcttgcttctttacttggttatttgtttatggtttgcctctccatgtgaatgcaagttccgggagggcagaaaactagtctgtcttgttctagctgagtctctcaggagtggtacctggcacagtagatgctcaatatattttgaatgaatgaatgggtggttgagtgaacgaatgttagtgtcactattgaggtcctctccgagccgtcgttcctttcacaggggtcatgcctgggttgcagggaggatgtgctgccccggggagggaggaggtgcggggtgtcggtgggtggggaggaggctgggccctggcctccaggaccggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcgaggttcctgcttccccgaagccgaggctgagagttgacagcgtgcaccctgccgcggtctgaattctttttaaaaagcaagaccgatgctgcgtttttatggatacccttttcttttctttccccttccccgaaatgctatgtaatcttcaattactttttaaaatataacgtggaggtataaatcaccccggtaagaggtaccttttaattacgaggtgcagtggaagagctgaacattggaatctagctgttagcgagggcggaggggcaggaggatgatttacaaacatcatgtaagaatttgagcactgaattatgtttgagttagggagatcccttacaaaggaaattataaccagtggacaattgtatttcaaaccgaatctattaatttcatgagccgtttcttgattgagtgaaatgtctgtgaccataatagatacagaactagtaagcaccttaccagactatgacccatttgttagcaactaacatacacatgtaaccatcctgcttacaaaaaaaaaaagaggtacacaaagaaagagtgggaggagagaacctctttttcaaaataatctttgtgaaagaatctttcacaattttactcgataaataaatgttcattttttccacttgtctttcttcatcaccttaagccccttcatcctttacatatctttgcatttagacactctcacacttgggtaagttcttctataatttatataacaaataacaaatgatagtggtttgaatcttgcttttgactaagcattaaattgtgtttgtattaaaaaaaatctccttgccttcgtagcaaactcttaacttttgccattgtgaaaagaccaatgtggttagatgcaaaagagcctgaacttttttttactttaaagcagtttatatgtccccattctcttgtaacttcagcttcacaatatcattcactattttatctgaaaggaattggcatttttcttttctgtcttaaaatagctcacctggtgttgtgaccatgtgtatgagaatactctataaacacacaaatcacttccccaatatcagaaaaactaaaggaaatataaaataaaataaaaagatgtgtatctcaatactttaggatttttttaaaaagttttcatcacgtaagttttagaatcttcttttcatgtcttttgttttgcattaaacacatcataaagaggtatgatttgttgacttgttataggattaccatttggcaaaaacgcccaagacacgctgtttcaaatatgtggtattacttctgctttaaattgcgtgtaagagattgcaaaccttgttccagatggataaattgataaaatgctagctgctgttgggagaatggaaaagccctcagcaaaaaggctctgtggtgtagctaagtacattttgaattagggtgagcaagctatggagaccccagccgtttgtgaaaaaatatacacagtccaagcacgtccactttaagacgttgttggatcctccgtgacaagatgactcctttcccacaaagaagaaaccgtttccttattttttcagttacttttccaaagacaacttgcatcgggcgcaagagagcagagttatgcagaaatccaaccgtaaccagctcagagcgaggactcattctctctccttccaccagatgttttttaggtgtcctcagctggaatgcccagtttgaaactaattaggccagcagtaaactccttgtataataaaatcgcaggccgtaatggtgaataagtgaggttcccagccgcttatgacagatgcctttctgggcagagagagaagagagcctgtggctgtcaggagaaaatgaagggagtggaggtgccttctttagacacatgcctttcctaagtatccacgcacatgatcgcagagcggaggagtggaagttgcgactggggtagagttttgtctttgctgggcaggcctccttcatacaaagatgcttgggggagaatcaattataagtattaggcagtgtcttcaggtcttaggtgtatgctgtgtgtgtgtgtgcaaaggcttggggagaaggattggtgtcacgtgcggggcagtgtaaaaaacttaactgcttcccacctgggcacaaaatgaaaagaaagactgcctggcctgacataaattccttgggagagaggagaacctgctcccccagagacttttgataaagggagaattcgcctaatgatgtggttccccttatctgtgaggtttgtgagggtgaaggagttggttagtctgttacctccaaaggctggactttctgactaagactgggttttgttggtggaaggaaccgggttttttgggtttttgtgttggttttttttttttttggttgtttttgtttttgttttttttagctaactgttctgaaaaaggagttggtagactgtgctcaaaaggaatctctttacaaagaattaatcccagagttaagaaaacacagcctgttgacagaaaacacacacacacacacacacacacacacaccacaattcttcactcactcccaaccctcttccctgatctccatcccccaatgtcataacagcttcctgaatggcccacttctccccactatcatttgtggcagttcaaacagtcctaaacatacaaaacaaaaagaagattctggtaagaaaacaattagcagagaattcgctggagacaatgcttcgttttcactgtttgaagatcgtaactggcctaatggtgtttgactaacacccttttctagtcggaggaggataaacaccccctccgtcaggtggtaaatacttgaagtgacagtaactgaggctgcagacccacttgtgttattgtaaatgaatcagaggggcaagaccttgttctttacggcgtgtgatttaaaatcagttttaaggtacctgccaggtgtatttagaggaaaaggcatgaaggaagccacaggcttatacattcatttttagtgcatatttctttttgttcattttcatcctattgagttcctttgtcatttctctgacttgcaaattatacccttctgtttaatagtaatgatgaaaatagctgctgtttattgagaactggtataccaggcctgcagtcagctcttcacgtgtatttttaaagtggattcttgccgcaaccccttgagtattattatcattatttcaactttgttaacaaggaaactgagtcgcaggtcaaatgaccgacacagggccagactgagtgaaaatgaaatctacgcttttgcttctctgcaaagtatgccttatccatgtgcaatacaagctttggctcaaaacatttctgctatcatttcctttggaggaagatgctgaatttggatggttttaaatgcacagaacacagttattttctgaacctgccctgacgttttttgccactgtcgtttgaaatggggaaacaaaatcatattaaatattcaggaacacaaatacaaacctctgtgagccatgacccttaaccggttgggtatggttctgtaaaggaaaatgacggtttatttaagggctaatttgatttattccttcgatactaacactacgcatttcaggtcctaaaaagagtcaataaatttaccggcagtggagaggccctaaaacattacggtaggcgcagcccaagtcaagtttaccggaaggtgctggatcgctatgggtgggtgttgtttcgggttagattttaaacatttggagagcaaagaataatttggaacaggtggtgccgagagtcaggtagctggaatgatttatctttgcctctttgaacgttaagggaggccactggttgcctgaatctggaaccagcaggctgcgggtcagtgggggctgagagactcgtctttgggacaaactttggcaggatccaggggcttcgtcagcgctgtcatcgcctttggatgatagtagtcagaacacagttgtgcctgctcgtgcatttttgaaaagtctgcctctgccttcagatatatgcagaaatctaaaacaggaacttagacgcgccgcaatgccaatttaaacatctttaaaaatgaacaaagtatgtaatagaggttagaaactcttttgtcatttggtatcaatagtgttgtgtcagtaacatgaaaatgtgtgtaatttcaatggcattgcactttcttcttcttttttccttttgagtatctagtaaagttacattttttaaaagtctgtgttcccagatgtaatagatacgaacgtatctacttgcagtcattcagaggagaattgtcaactctctgctaatgtaactaaaggaaaaatgataaaatcaacatatttttccccaaagaatgaggaactggagggtttgactactgtatatggcaacttacttttgtctcgcgtcagctaaatctgtcagttcccctttcttttctattcatctcccaagaatggcctttcataactgaaatacacgtgtattagccaaaagacattttaattttgtaaagaaaaatcatgccagagacagccgggtctgtttcaaccattattgtttctgcagcatgcatactttgggtttcatggtaagatgtgggtttgtcaagaaagaaaattacagcaagaagctatgctgaaaacatatacacttctgtttaagaaatgagaaaaacacagaaaaattccacacagtaattgcttttacgtgagttttaaatgtcattgtttgacttatgtcaaaaagcccccttagccagttctctcatactccgttaccaaatatctcaccttaaaaacagcaaatgttggacttcattttgatgatctttgaggctttcagagatatccttagtcctagtggaaacattccaaatttttagattgtgcaggccatttttttaaggttacttagatatcgattttattttcttgacccaaaatgagaaaacacggggaattctcaaaagctttttacaggctgctattacgagaagagaagccaaaccaacatgtattaggtcatgcgcttgaagtgcataaataagccctatgaaggtcaccaaacagggtgaaaaccactagttctcgttaccttggccacctctaaattcctgcctgttagacgtgtttggttgaagtggacacagaaagcgggtttccgagcccgtggttgaaagatctcaatttgacttgggtcctcaaggcgtccttgtggtaaagggagataggaaggctgaaattctggtctcctccccatggctccctctcacggttccggagaaaaagcaggtactggggccttctcttactccaaagcagatgtttcctacctggtattcggatatgcggaagtcagaagctgaaaataaaatgaaatgaaaatgttccttctggtcagtttcttcacctcccattcccttcctatagtcactttgtggttaaggtattcatggtttccaaaacaattttttgttcccactatgttttctagcatttaagatgcaaggtataagtactcacctttaaatctctattgattggcagcttcctgaaatacagagtcagagagcgtgtccaccacgtcctgagtttggtaccaacccaggtgctgatggaaattccaagtagggagaaaacgtcctcttcggagaggcagggtgtcagcgcaaagaggttattttcttttgtgggtgtgtattatttgcacatatcaggacttttgtttcagggtgttctagaaacattgatctctccagcaaagttctgcgtgtccttcttggttgggaagggagcggagaggaaggagccccgaggagaatcgtgcacctttggccttttgtgtgactcctagagtagagggaagcctccgctgctcggaaggtgtcacgtggtataacaagttgtgacttgtgcctgtgttgtcaacagagttttagccccgtccagacatgaaaaagaatggagccccgaagatgattcacctccggtctgcgatgggcccaagctgtccagtgctctcctcttgctaaacagaccatactccctggaggagttaatggctggggtgtggagagaagaccggtaggaggggagaaagaatgccttaaactcagcaaatgtctaaaacgctcaaaatgtctcagcattgctcaggcacccacaagaaagacaaactgataaaaggacatagaatcaggctttttttgagggggaagcacagagaggttgggggtttgctagaggtttgatctagagtggacaatttttctaacaccttgggacccgattttggaaatgtcttcctgtagccttgctgtcattcctttgtgcttatttttagtgaattagttttggggattttcttttgtttttaagaaaacacagagttgtaagacttgtttgggaatcacaggttttattgaacacttattatttattgaatatttattatgtcccaggcattgtgctgtggaaatactttatatgttttgtctccaaatggcagtagatggaacgtgctgttattattatttctattttacagatgtggaaactgagtctggagagtaacttgtccaggatcacatggcttatgccagagccaggattaaacccagttttgattcctaaccactaggatgtccagcctgctcccgtggtataacaagaacttccctttctccatctgtctgccctggagagctagattttaaagtccttttccacttgcattgccttatggatatttatcgatggttaggtacaaaaatcaggttgagaaagtaagagacgccagcagattctcacaagattttgaatctgcccttgtagaaatgaatgaatgtttcaagctggacctatggaaatggtcgtagcatcactgcagttagtggcctaagtcattgcttacagctgctcttgccctataaccgcagggttgaacagccgtactacaaagaccatacggcctgcaaagactatctggccctttacagaaaaagtttgctgacctctaagctattgcaatatgacaagacaatccttgtagaccagaaataacatgcacttgggacatttcgtataccatttcaatgatttattatttatcaggtgcctccaatgtgcttgacacattgcacagtgataggggaaaattacaagtgacttcattccttcatccatttacttaacaacacttatttagctgtgttctgggctgtttactggagagccagaggtgagaaggaccaaatccagcatctccggtaggaggatcccaatgtgttctcaccagtatcccatggcctcttctttcctgagggtgcagagggtgttgacatgactttttgagctttctaatgtttgagcagcagaatggaagcaacacctcagtctgtagaccctcacccacagaagctatgcctggttcagtaagagcagtgcctcggcttctgcacctgaaaccgcactaggcatataggacttaccagtgccccaggcttactcggccgacagcaactctctgcttccctcaatgcgttgtgcagaatgaggaggaatgtagagaatcagactttccaaacctcagcctgggtactgactttcagcctcgagattaagagcttgagtccaggagccaggctgctcaggttacacttcccctcagtgttaacctactcctgcgtttaacttgggggtaagttaccagacttttcggtgcctcagtttcttcgtctgtaaagcagggtgaataataatgcaccttcctcagaaagctatcgtggagattgagttaataaacatgaagtgtttggaactacggctggcaagtggtatgaattatatcagtgtcagctacagttattattattatttatgaatttgacctgaagcaaattacttagactctttgggatgataataataatagtaacaacaataataaaataacttttcatagtgccattgtgagaatataaatgaggcgatacatggaaaacacttagctttgctacactgcctgcctccattcaatgttcaatgagctagctattgagattatggggaacagtgcactggatcagtgcggtgtctataagctattgatcagttgagtcattttaggtatcgagagaatgttgggcagtggtcgatagcacaggccctggactcagacagatctggcctgagcctgagtcagtccatcactcacggactgccatctccagcaggggtctgaccctctcaacgtcccagacatcggagacagcagttaactgttcctggggtggttgggaggcttaaaagagtggctggcacaccgagcacagagcagggtgtttggcacatagtaagcactcaataaatggtagcttgtattattaccacccccatttcttgctgtacccccacccccaagaaagcactgaacattagtaaattttaatttgaaaataaaagaacacattttaaaactgccaaacagatttaaaataatattcattacacaaaattaaaatattctattaaagccagactttgggctcagaccaaatttttataacccaagcttaaaggccagggagtcccccagccacaatggggacattgtgattgaacttgagacttcaacgctgctattgagcagtctttgaaatgcatgtttcccctaaaataaaagggaagtaatgggaaggaaaaaaatgaggttcttgctcccctcaacaagccttaatgaattggaaaagaaaaacaaaatatttctcatttttctcctgctactcgatcctgccaaagacgcacggcccctcccaaccctggctttgaatggtgcccactcagaaccttccagatctgatatgctatatgagcaaacctaatctaagttgtaacattgtagtcttcaccaggttttacagatggcggattgtatcactgggaatccagaatggggagcccaaattcctaggttcaagtcctagttctgcctcagtttccctattcacaaaatagagacagtcctcctactgcataaagtggtggtgggagtctgaacggttagctctccccatggatgttttaatcttctgctgttacctaatgaatgaaacttgccctgagttctgggactttgaaaaattaaagtatacaggtatgcctctgagagttataaattaaaaaaaagtctattcagggaggagaatggaggagggaagaaggagacataaaaatggctcacaggagttattatgtgacagacactttcacaaagctcatttaatcctctcaaaaaaaaaaaatacatgatatacatgtgtccatttaacaaacatggaaactgagacttggacagatcgagtgactgcccagcggcattccattccaggtctgtgtgacccaaagcatgggcctgttgtaccacatgacccacagccctcctggaacaaggtcacaaacaatcatggtggactggagagactcccctgaccaaccagttatttatgatctattcttacatttcaatagcatccttcatcctcaatgagcctgagttgctgtggccttttaccccacattccattgagaaccagtagattttttcttgaacagcacatggaaaaagtaacgtaagtgggttgcaaaatccttttctggatgaaatccttcaagaatccctgccatttcttgccaaccggaatgaagtgacttcctcctcagaccaggccaggcccttggctatggtgtgggaccatgagacagagttgtctgaggctgggcagctcctggagagggtatggggtcccctctatcaccaacctgctgtgtgtcttcgggcagatcacaagagccctctgagccccaatctcctcatcagcccatggagcagacaccttctatataggatttgttatacgacttaaataaaatgacagtggaatacttagggtactgtggaattggacccattcccaggagtactcaaagaaaggggagaaaatgaaagttacttgccccaggcacattccttactgttcttcaggtagctaccgtttggggactttagacattctggaagaatctgttagtctctgaagggcagacttctttttaatgatgtgggcaccctttccacattaacttgaaatgtacatggacattttttttctttagagttctgtctctatcttattatgcatttggaaaagatataaaaagcatttgaaacaaatggttttacaattttttactgcttaagacaaaaatgatttaaaaaccaagtccatcaagtaattgatagcaaaagtggcacacagccatggcagagttcatgagggaagtttcagaaacacgaatctgatgatgtgaagctttccctgtgatctattcatttaaaataaaacattttagttttaaaactcatccccgcaggctgcgtacgacaaattccacccaaatacccagaaccttttactaaccagaattgcaatgctgtgctgctttcaggggaataaaatgaaacaaatgcagtctctcggggacattggtaaagtcatctcagagtacatcagtgtccgggcacatctagtctgtgtcttgtatctttgaaagaagaataactaacctttggatgactgtaatgttgataaaaaataatctctgagggctaactttatgccgggatatgttccgaaagattataggcattaactcatttattccttgcaataattctacgatgaaagtactgttactattcccagtttaagtgagaaaagtaagacacagagaggtcaagtgacttgttcaaggtcacccagcaagtgcaggggtagagccaggctttgtatgtgggagtatggttctagagtttgtcttcataacccctgacttccctgattctttaaccaccataaaaaattaaactctttgaccctcacttacttgcacaatgaattaattaaggacaggcatgagaaggggctgaaagcgatgttaaatctcagttataatttttcagtttcttacaaggatgtatttgcgtattccattatctttagggtacagtacactacagaagccagtctctccacgttcaaatccactgtctaccacttactagccttgggcttccttcacctctctcagcctcagtttccccattgatgacatgaaaataacggactctgcataacaaatgcattgaagaccacgagacacacacagtgattgttaaaagctattgattacctgtggaagaaaaattaagtctagaaatcatatcttcctacagggcacaaatgcagtttggtatagtttggagtgaaaaagaagggaaaaccgcctgagctgtgaggttcaagctggaaaatagctcaggtttttccagatgccttaagactgagccaaagagaccggctttccatgtctccacatgagaagttaccgagctaagtcctcaacaggcagcctacaagccattgatgttagaatctgtccaggtgaggaagcagcagcctgtgggagggtcttgcccatggccacatggccagtctgtggcagagtggggactccccaccctctttcaagacgagtgagggatcttgggtagcatgggtcagaggtggagaggaacacataaaaacaagcgtgaggccaggcgcagtggctcacacccgtaaccccagcgctttgggaagccaaggcaggcggattgcgtgaagtcagaagttcgagaccagcctggccaacatggtgaaatcccatgtctactaaaaataaaacaattagccaggtatggtggcccgcatctgtagtcccagctactggagaggctgaggcaggagagttgcttgagcccaggaggtggaggttgcagtgagccgagatggtgccactgccagcctgggtgacagagggagactccatctgaaaacaaacaaacaaacaaacaaacaaacaaagtgtgcctggagcgactgtctatgcaaactctgacatcagctctaggctctagtttcatgattttcattttatttcttgttcccttctttacattggggaaaatgtgtttttctctagaagcaactacctggttttcagtggcaaggtgcacagactttctgggttttccattcaccattctcctccactgtgcctcccgcttccatttcctcttcagtatggaaatggcacttatttattcattcattcaaaaatatgtattgagcacctgctgtgtgccaggccctactctggacgtggggaatgcagtcaagaacaaaaatgaccaaagtctccttccttgtggagccacagttaagtaggagagagaaaataaacacatatgtatataaggtacgcagaatatcaaatgataagtccatggagaaaaaaggtcaagagaagctgacgagaacatgcccaggggaggcgagaggaatgcagcgctgaaggaatgtaggagaacattctagaaagaagcggtagcaaggacaaaagtcctgaattgggagcagccagtgaacaaggagggcagggaagatgaggccagttctggtagggccttgctcagaatccagctgccgttctgcgtcaatcagtcatgtccagagtcaaaattatcgtaatttaaaaatgatttttcaaagtacatagagcctaaatctgaaatcaatgactgcaaccgcagatacccagagaacccaaacaggtaagaattagtggagtaggtatgctaatagcagggactccacccggtgccattcaggaatggtctccgtgttgctaggtgttctgatttttcaaaatctgaatttttaagagaaatgtcccgcttttaaaatcactatgaggaaccaccagaaatatacctccaggctcatagtgtacgatccctctcccaaacatcgacacagaccctgggaatcaaatttcagtgaaaaggcactaagcctctctcccgcactttttttttttttttttttttttttttttttttttttaccaattcctgaccagaaaggatgccaagagatgctaaaaattgtttccaggaaaaagtaggacttgaatctcatggggatgaggctgagacttcttccaaggagcaatcagcttgcttcattattatgtctttctcaggagtttttcctgatctccgctcatcatggggaaaggcaagatggtccaaatctatcctccttcgggttttcattagtttcttgatgatgattattatgtcatctggggttgatttaagagtggtgaaatgtttgcaggtctcataaatggttgtcagccactgtttagaatggcaaagaactttttatgttgttcccattgcaaggagtggggtgatagtttccaatggctacagacaaaagggggaaagtgggttctgaagccttttacaagaggagattggaaagttgagtaattcaatgggggtgcaggtgggaggcagtaaggaaagctccaggagctttttaagacctgagatgcctacattgacaatactgaaatcatcgtcggcctccccagccccaaagctgggcttaagcaaaatcccagccagtggtcgccttagctgtggagattgctccagatgtaagtgacaaaaaaacttacttctgagttggtttaagaaaaaagaaaatgtattgccttgggaaatgaaaagttcgaggagggctggtttcaggtacagctggttcaagagctcagatgcaggtcatgtgcccatctcttaatcagtctctctgttcaagaggattctgtactgtgccacctgtggagctgtggatggagtgagagaaaggtagatttccaaagtgaaatcggcagcattttctggaagtgtgggtggactggttccttatatcccccaaaattgtacctataggtatgccttctccacccctctcctcctggactacagtgctgcttatgaaatttgtgctttttccaggcacgatgttatactctttgtgtgcatgttttacttttctcctcaaacattcttactaggtcagtatttttaagacctgctactattctgccctccacatgctcttccccatgggcctggaagattatcttttatttcaagtaagggtgtttgtcttacttatttcaagtaaggatgttcatcttaagggtgggtcatctgtatttgtctgttcttgcactgctataaagaaatacctgagactgggtaatttgcaaagaaaagagttttaattggctcacagttccacaggctgtacaggaagcatgttactggcatctgctcagcttctggggaggccttaggaaacttacaatcatggtgggagacgaagaggaagcaggcacgacttacatggtggagcaagaggaagagagaaagaggcgggaggtgccacactgttgtaaacaaccaggtcttatgagaactctgtcacaagaacagcaccaaaggggaaaatccaatcccccttgatccaatcacctcctaccagaccccacctacaacactggagattccatttcaacatgagacttgggtgtggacacgcatccaaaccatcttatcatctcttttcatggtctctggtacaaaagttgaggcactccagccaagcataggacatgcgctgggcttcagaggataagtgagagatgaatcaggatcactaggagtagaagggttaccctggcaatgcacgcattcccaggcccctgatggtcagcctggatttctttttctgctctgagcttttgctcccgttgctgcctgtattgaactttctcatgctccatctaggggcatggcagtaacatcgggtacacacagaggttgcacactggcaatcaagatgtgttttgtttggtctgcagatcatttaaaaaatagaatggagccaactttgaagatctggatctttcacacaaaaatgtagattgctggctcccatcaaaacatcacaagatctgtcaacactgtgcccacatttccacattaccgcagttgactggggctgggaactgtctgtcccttttaggtggataagttagttcacccaagtcctcacctttccctatagtctctccaacaccgaggttcaggttagttaccatttaccgttgggaccatgctgttggctctcctagagtagatttaagacagaaaagaaatctttcctatatctagatctccattagaagtatgaaaatgaagtgtaaaccaaggtggtccttggtatttacaaaaaagagaaagcatctgtcttcaggtaacacagggtttctcaactttggcactattaagatttggagctggataatttgtgtgtgtgtgtgtgtgtgtgtgtgtgtgtccactctgtatactctaggatggcatttaatatgtccatgtggacatcatgcaccatctagaagtaaataggtccctgtgctccaggcgctcaccaccaggttggtacaaagagttaccataagtgaggaaagctgttcttctgcatggcacccgggcaggctcagcattggcagtagaggttatgagttggctgatttttgatttagtcctaagtggacttgccaaccattgaggctgtttatgactgcctgtttgagatgttatagaaggaattcagtgttgaatgagaggttaaactattttaaagagtctttggagaatttcttaactcttagctgagtgaggccatggtggatgctacttgcaaaaagtttgaaagtagcatggatggaactggaggacattatgttaagtgaaataagccagatgcagaaacacaaatatctcatgttcccacttgtgtgtgggaactggaaaactcgatctcgtggaggtaaagagtagaatgagggttcccagtggctggaaaggtgggggtgatgaagagaagctggctaatgggtagaaacatacagctacatagaaagaaaagttctagtgttcaaaagcacagtagggtgactgtagtcaacaatatgttctatatcaaaatagctggaagaaaagattgaaatgttcccaacacaaagcaatgttaaatgtttgaggtgacggatattctaaataccctgatttgatcatcacacattgtatgcatgtatcagaatatcacatggaccccccataaatacatacaattgttatgtatcaataaataatcttgcaaatagaaggtggagcatgggcagtggttgggcttgttggagagtgagcagaaggaccaaatgacctctggatgtctcttatgtctcctccagctctggttctgtgagctgaggcttagtgagtttcaaaatgttgcctactacatgttcgcaactgctaaccgtggtctaccatggaaactcaaaggcatggatattcagggaggaatctcatttttccctaggctagtactgtgtacgaggtgagacttttttttctttttggccttcccctagtgttacaaatcctgtcgagtgtctgaaataccatccatgtgaaggtttcccatgataactgtaacagctgccattcatccattcaacacatatttattgaacacttctatgaggcagccactgttccaggcacttggcaagcagctatgtacaaaactgacaagtccttgccctcatggagcttttgtttaggggggaaagaagatagacaataaaaaagcaaatagtaagacagtcttggcattgctatggggaaaaagtaagtagaggggagggaggttgatgggaaacattgaggtagaacagggaagaggaatttttaattttttttttttttctttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttaattttaattttaaatagggtggccactgtgatggcatgctggtaaactggttctctggaaattaaaggtcctgatttgtagcctctgccacttacagtggtgtaaatactcccaccatggtcacttacagcccaacagtgattttaacaaggagttcacaacattcatgcacatttaacaattgtttcttgcaggctggtacaggctggctgcagcacatcactggcaggcaaggcctccctgaaactatctggcagaagagcccacacagaagctctgagtggggttgtgcctggtgtgttcaggaatgaccaggagttcattgtggctggagctgagtgagaggagaggggcaggagatgtagttagggaagtagccaggggcagataatgtagggtgtttgaggccagggtcagatttttgacttctaagctgagtgaggtgggagtccctggaggaatgggatctgagcagaggaaggacatgatctgccttaagtagagcagaactcctctggctgccaagagaacagactgcaggggtcagagggtggggcaggaaaaccgttaagagactgttcagacagggaggtgacggtgacttggaccagggtggtggcagtaggatcagggagaagagttggattctagatatgcttttaagatagagccgatagaatttgctgagggattggctctgggaagggatatgaagagaggagtccaaggtgactccaaggcctctgggctgggcatttgggaggatggagctgccctttgctgaaatggggacagtggagggaggagcaggttgggaaaggagatgggagcacctcgtgtggacctggcattgagccaggtgtttgaatatatgatcatctccttctgtccattttatcacgcccattttggaaaggatgtgacagagagttgaggttaatcagcatgcccaaggtggccctgctggtacatggccaggccaggcctcccacccctttaccactctgctgtcctactgtgttttcttggctttctcagtcccgttcctcctcttcgttttgaggaaatgacaacaggagaactctgcagaagaaaccacctaggagccgagacctctccctcgttcctaaagagctgtccagcggttaacgctggacacacatcaggtctgctcagtggatctgtcacccacatttttccctgacaaatttgttggattaacctcatgaagatgaatattccacagtagaactcacacttaaaaaaataggagtcagtggcataaaggctttgatttttctgtggacacaggcttaaatccagattctaccgcttgatggcttctccatgggagcctcagttttctcatctgtggagtgggtgtgtattactccattctcacactgccaataaagacatacccaactgggtaatttataaaggaaagaggtttcattggctcacaggtcagcatgtctggggaggcctcagaaaacttacaatcatggcggaaggggaagcaaacacatccttcttcatatggtggccggaaggaggagaatcagtgcccaggaaagggggaagcctcttataaaaccatcaaatcttgtgagaactaactcactattgtgagactaggatgggagaaaccacccccgtgattcaattatctccacctagtccctcccacgacacgtggggattatgggaactataattcaagatgagatttgggtggggacgcagccaaaccgtatcagggagtaagaagagttcctctctcagattcaaggagataatgggctgaggcacttagcactgtgccagccccatcgtcacactcagcacacagagggaatcatgaccatgattgtttgagagagggaattagaaagttgggttcagttttaggcaaaagctgacctgccttcaaagctggagtatggggacagggggccgtgcgtgggacatcgtgcttgagagctttgcagtttggccttttcttttctctaccggagatgggaggcctctgtccgtgtttctgctgtgttcaccaggaggccagtctggggcaattactgctccccatctcccaaaggagccacatcagcctcatagcagtgtctctagcttcgagctgttgcctgtggcaggcagaacagtgtgtactcgcaacaagcaaatccccagatgtgagcccattcggggctgccacgttttttcctgatgaaattcctgacttggtgtgttgtgtttttttaaaaaacacgcccactgcctccaaaaacctcagccggggaagagaaacatttctcgttgaattcccagtttttgaaacggtgtcaaattatgcccctctcatggcctggatacgccattctttccacttagtgcttttcagagaggcctgggtggcagaacgtggatgttatctaggccagcctttgcattatacaggtggggaaactgaggctcagacaggccaaggaggagccccacatgggaagttggtctcagagccttggtgatacccccagatctcttgattccaggcccactttcttccttcttcatcagaggtcacaaatgggcaggctgcagccacctctaccctacagatgtgctttctttggcctgagattgttttgatttgaatgagttgccggcatttaaaaattaggagattccatataaaaacccagatttctggcttctctggggccattgggagatctgccaaatgagctgtgcattcctgcatggtgacaattgagggtctcagtcatggccactccctttagccagagcatgtcttcatcagttcaccacagtccccgcccctccctctagtacccccggacctgggggctcaatgtcacttgtcatcatggcgctttccctcccagttctataggggtgcagttaagagaaaagtgaagtatttcttgaaactgtgtctctatcaaaaagaaggaaacaaaagatcaaccgaaatgaccacttgtttaaacattaatagtacatagcatgattgctttgtggcagagcaaaaaatttctatgaatttcatatgcaaagagaatacgtcagtgttgaaaatcgctggccccttcactctctgaggttaccttccccttctctgccagtgttacacttgccatccctgcgtgccaaggccatagtttccacttatttttttaaggcagcattaaacttatttgacctacatctgcccccctcctgtgaaacttgaaatgctattaaaccaaattaagaagtttttaaaagttgaaatggtctttaactgctcgagaaagggtgtatgtgaatatgtgaatgtattgtgcagtgtgtgtgggtgtgcatggacaagtatgctgtgtgtgagtatatgaatgtgggtgagtgtgtcagagtctgtgtgaatatgtgtaggtgcttaagtgtgtgagtttgtgtgtgtgtgtatctgagtatgaaggtattatgtgtgtgtgcatgtgtgatgggttcttgatttatagactttgcaccaagtagaattggacaaaagtgtttttctttggctctgggactggcacttctgggctttaccatacatttaagccaaggtgcaaagccaagttggttttaactctaatgccacgtcagtgagctgggttgagattgaggttaaggttgactttcctttcttctgggatatagtggggggcttttggaggggagagctcggggtgctaggctttacaaatgatgctcactttcttcccagagcagatggccagaagagagggggctcacactttgaggcctgctgtgtgccagacattcatatgaagattatctctctactgttcgaagtgagctttggacccttccttatttactgatgtgttcattttggttctgttaggaaaaatatatagagagataacctataaaatacataaattagtagtatttcttagaacaaggctcagtttatttaaggaggaaaaagagttcatttaaagaaaaaatatgttaaatgatatagtttgtggaggtgagaaaatcacaaataattgatccttaccatgtgcaggagtggtcaggtgggcagcctccccccgagtcaaaatcttcctaacatcttgtacttcctcaaagcacttaaacttgttaaatacttaatcgtatatgcttttgcataattttgtctcttttcaactaggactgtttatgtcatttcaaggttgcctttccagcatctagcagagtgccaggcacgcaggaagtgctcaggaaatagcagcgaatgcatgcacagactccctgccaagaggggaattactgtccccattttatagatgaggaaactgagggtcagagtgacttgcttaagatttggcaactaggatatggcaaaacgaagatttgaacgcatgactctcaggctgcacaaacctttttgccaaacaccaatacgtgggactcaggtcagacagactatgaccactggcccattgcaaaatgaggaaagcgaagtggatgtgaagagtttcataaagctacaggcattccttggagatgctgcggggttggttccagaacgccacaataaagccaatatcgcagtaaagcaagtcacgtgaattttttggtttcccagtatgtatgaaagttatgtttacactattactgtacataggccactaagtgtgcaatattattatgtctaaaagaatgtatgtaccttaacttaaaaatacttcattgctaaaaaacgctaatgatcgtctgagcctttagcgagttgtagtctttttgctggtggagggtcttgccccattgttgaaggctgctcactgatcagggcggtggttgctgaaggctggggtggctgtggcaatctcttaaaataagacaaacatgaagtttgctgcattgatgaatccattctcttccttttatgaaacatttctctgtagcatgcaatgctgttttatagcattttacccaaagcagaacatctttcaaaattagagtcagttctcggctgggcgtggtggctcacgcccacaatcccagcactttgggaagccgaggtgggcggatcctgaggtcaggagatcgagaccatcctggctaacacgctgaatccccatctctactaaaaaatacaaaaaattagccgggcgtggtggcaggtgcctgtagtcccagctactcaggaggctgaggcaggagaatggcgtgaacccaggaggcggagcttgcagtgagccgagatcgcgccagtgcactccagcctgggcgacagagcaagactccgtctcaaaaaacaaaacaaatctcactctgtagcccaagctgatgtgcaatggcacgatctcggctcactgcaacctctacctctggggctcaagcaattctcatgcctcagcctcccgagtaactgggactacaggcacatgtcaccacgcccggctattttttttagtttagtagagacgggtttcaccaggttacccagagtggtctcgaactcccgcactcaggcgatccatccaccttggcctcccaaagtgctgggatacagacgtgagccaccagcacctggcctatttccaccacatccgcagtgacttcctccactgaaatcttgaacctctcaaagtcattgatgagggccagaatcaacttcttccaaactcctgctaatattgatatttttacctcctcctgtgaatcacgaatgtccctaatggcatcttagaatggtgaatcttttctagaaggttttcaatttactttgcccaaatctatcagaggaatcatgacctatgacagctatggccttatgaaatgcatttcttaaataataaaatttgaaagtcaaaattactccttgatccatgggctgcagaatggatgctgtgttagtgggcgtgaagacaacatttatctccttgtatatctccatgagagctcttgggtgaccacgtggactgttgtgagcagtattattttaaaagaaacctttttatctgagcagcaggtctcaacagtgagcctaaaatgttcagcaaaccatgctgtaagcagacatgctgtcatcccggctttatgttattctgttcatagagcacaggcagagtagatttaacatcattcttaagggtcctaggattttcagaatggtaaatgagcattggcttcaacttaaagttatcagctgcattggcccttaacaagagattcagcctgtcgtttgaggctgtgaagtcaaccattgacttctcctctctagctatgaaagccctagatgggatcttcttccaatcgaatgctgttttgtctgcattaagaatatattgcttagtgtagccaccttcatcactgatcccagctagatcttctggataacttgctgcagtttgtccatcagcacttgctgcttcgccttgcacttttatgttataaagatggctgctttccttaaacctcctgaactcttggtagcttcaaacttttcttctgcagcttcctcatttctctcagctttcatagaattgaagagagttagggccttgccctggattagcctttggtgtatgggaatgttgtggttggtttgatcttctatccagaccactcagactttctctgtatcagcaataagactgttttgctttcttatcactcgtgtgttcacgggagtagcacttttaatttccttcaaaaatttttcctttgcattcacaacttggctaaacatttgttgcaagaggcctagctttcatcctgtctcagctttcgacatgccttcctcactaagcttaatcgtttctagcttttgatttaaagtgaaagccatgcgactcttcctttcacttgagcactcagaggccattgttggattgtggattggcccagtttcagtactcttgtgtttcacggaatggggaggcctgagcagagggagagaggtaggggaacagttggttgaggtcagaacacatggaacatttatacattaagttcaccatcttatatgggcacagtttgtggtgcccaaatcaattatgaataatatcaaagatcactgatcacagatctccataacagatataatagcaatgaaaaaactttgaaatattgagagaattaccaaactgtgacacagagacatgaaaatgacactgataaacttgctcaatgtaggattgccacaaaactttaatttgtttaaaaaaaaaaacagtatctgcaaagtacaataaagcaaagcaataaaacgaggtcttcctgtatttgctttattgcggtgatctggaaccaagcccacgatatctccaaggtgtgcccgtatactgttccaatttaaaaaatggtctgttatttttattttcttcctattttgaggacgtgacacgttatctttttatgactaaaatttctcattttttgtttttaaatgtttcactggacaaatcaaaatggcagcctccttttgtgggttctcccagtttttttctttgtattgctttttttcgggagggagattttctagttggtggaatcccagagtctgagaatcatcagacaacttcaagctcctctggagatcttatcaggtccattggggaaatctctgagctcccctctgacttctttccaagtcacttcaccatttccccttcatggggtggggccagtgtgtctccctcattccaggccccagggacacaaatgcaaaaaccagagccacatctcaaggatgtgtcctgggacctctccagagggccagagcctgcccttactgattttccagggagctcaggactcatcatctctctgggagaaactggtgccacccaggatggccttggttagtacggcatctcttcatgggctctgctcacctcttttggtttcagcacaatgcagctttcctttccattttcttaaccaattcagatgcccctcatctaactgctaatcatagctccctgttgagcgaggtgtcacctctgaaagtctgcccattgttgaccctgcggtctcttcttccaggcttggaggctgggtagatgccatttctctaaccctgccagaactctagctgtgcccacacctccgctggctcttagtaggggcgccttctcagtggggaggctgacacagggctgtggagacttggagccagcaatgcgccggccctcgcctcagagagcttggagcctcgtaggtgagaccaggcaagcacagatgtttccttgggactggattctaggccctgttgagggctggagggtaacctcttaggcttgcatagtatattacagtttacaaacagtctccacatttattttcctcatgtccatttgtagtcctctgcagtacgtgatgcttatcttgcccagctggcatccattcatctcctggttttcttttctttcttctcctttctcgtttctactgcaccttcaggccattaccccactctccagttctaagtgcagacctgtgacctccccatgggcagtcacaacatgctatgcctctgccctcagggttcaggcacaggaactggacccaggttgaatggggcccaattctgggaactttgctggaattgttgaggaatgatgccctcttttctctgggttgctaaactcatagaatgtagccatcttgcttaggggaagcctgcctgaaactaaaggcaactcaaaggaagacagagacaagatatggagggcaaaagattcccaatgacctcatttgagcacctggatccagctgttcctgaagctagataccatgtgttattcccttatattagccaatacattatttcttttttacttaaagaagtttgaatggagtcttctcccaattgctataaactaatacaggtggttttgcatttactaagttgccctgcttcctctgatcacagtaaaactccctttcatgtatgaaaccctcttgtaagtgttttcatagcaatcagactcatgtctactagacacagcactggcctaatttcagtgaagagggatttgaggcacagaagagaagggaagcaagttgaggctggaacctgcgtttcctaacacctgttctagtgcattttccacttggagcatcctcaccagctttcagtttggagaacagtttttaatacccaggacatcatcaccccggaggacaggagtgctaattgatttaatgaacaacccaagcaaggtcagagaaaactcttaactacatcacagagtaatcagaagagttacactaatggtaattttaggtgcctagaaaatctctggtagataagagaggaaatagttaactgtagttacccaggggaaaggaaatggggaaaaggagattcttagttttttactgtgtatactctactgtacattccaaaatgttttactaggggcaccgattgtttcatattcaagtaaacagtgaattttgaaatgtaacaacagcaggcttccatctgagacaattagagcatcaaatagtgaattataaaccattgaaaaaatacaaacctatgaatatataccactaataaataggtaaataagtaaatagggaggagggaggttttgtgcttacagtcgaatgccgaggaccagctagaattgtgggggagagctgggtaagaaacacaccatgttgcgaccactataataaagattggttcagtcaagaatcatcatcaatagatgctgaatttggggtggggatgttgataaggagtagcattttgcatggtcttaagtgatctcttcacgatggcttataaattttaagagaaaataatagtcactatgcagtgcagaaattggtgatctgtatcaatgtcatcactgagaggcagatagacaggatgtccggagaaggacgcagcatcacccatgcagtattctgggagggtgcatgacccgaatctaataagaaaagagcagacaaacctagaatgaggaacattccatttcaaaaaaaggtaccttcttcttcaaaaatgccgatgttgcaaagtacagaaaaagactgaagaaatgttctagatgaggccgggcacggtggctagtgcctgtaatccaagcactttgggaggctgaggcgggcggatcacttgaggccaggagtttgaaaccagcctgggcaacatggtgaaaccctgtctctactaaaaatacaaattagccaggcgtggtggcagacacctgtaataccagctactcagaggctgagacatgagaattgcttgaacctgggaggcagaggttgcagtgagccaagatcgtgccactgcactccagcctgggtgacagagtgagactctgacttaaaaaacaaacaaaagaaatgttctagaccaaaggaatctgaagggataggacaactaaatacagtacccagttctagactggattctagatagagggggagatgtgatacaggaaattattggtgaattgacaaattgtactgtggagaatggattggttaaaatattgtgtcagtgttaaagtgattgaagtgggtaataaaccggagattctataagagaatgttatttttcttgggaaataccattggaatatttacgagtaaaaggccattatgcatgtaactctgaaatgatgcacaaaagaaaaataatacacgtgtgctgggtgtgtgtgtgtgtgtggagagagagagagggaattggtaagcacatgggtgaaacattaacagcagatgcatctgggtaaaagatctgtgagtattctttgtactgccatcacataggtcagcctctctccaaaacctgcactcttgtttactaaaacagtatttctcaaaacatggaacgccttagtgattttttttaaatctcattttgctaactttcagctcttttaattaagcccaaaagagaatcttaagttggtgctggatggtttggtttttaacaccaaacacttgctaattctctttgtataacaaagagagtcatcaggcaagcagtggcctctagaaagatctatctttcatgggggattcctcatattaatttttctagttatcttctattttttgacagtgatttatatttgtgatttttaaaagttcctttttaggtatattaatttaagtttatttttaacttgttttaggaagtgagtcaattcaaagaaaatattaaggtggtgacagtgcacggtatgggtggcacatggagatggcagaggctgggaaggactaaagtttcagccactgcagctggaaactcctctcaagtttaaaatgtttgggtcaaggtgacactttcccgtctgtggtccctgctttcttaacactatcattcagaaaggccccaagtgtaggccgggcacgctggctcacgcctgtaatcccagcactttgggaggccgaggtgggtggatcgcgaggtcaggagatcgagaccatcctggctaacacggtgaaaacccatctgtactaaaaatacaaaaaattagccaggcgtggtggcgggcgcctgtagtcccagctactcaggaggctgaggcaggagaatggcgtgaacccaggaggcggagcttgcagtgagccgaaatcgcgccactgcactccagcctggccaatagagcgagactccatctcaaaaaaaaaaaaaaaaaaaaaaaagccccaagtgggtaattcctttcctctaaggcagtaaccagaataaacccttctctatcaccaatgcatgatgcttccattatgtttcacctccctaatcttcagaacttggaagaatgagtttggtaatgttagactggaaactcagaccaaggaggctgtgttagtttcctgggactgatgtaaaaaagtacagcaaacttggtgactttaaacaacagaaatttactctctccggaggtggaagtctccagagagcctgcaaggtgttagcagagccgttctccctgagcctaggtagaattcttcctcacctcctcctggctttggtggtggccatccgtccttggcattctttggcttgtagccatgtcaccccaatctctgcctctgtcatcacatggccttgtccctgtatgtcttcatgcagctttttataaggacaccagtcacattggattgaggacccatataactccaatatgacctcatcttaactaatcacatccacaatgaccctatttccaaataaggccagagggtgacaactttaatatgtcctttggcggaacacaattcaatccatagcagaagtttactcaagcactcaagggctaggaaagaaaagattcatgactggccctatgtaaaaataaaacacctcagcataatgcaaataccatatgcaaaatcaaaagataaatgacaaactgggggaaatctttgcagttcatatgacaaaaaaagaggctggtttctccggcataggaaagagagttcctagaaattgatcagaaaacagtaacaataatccattagagaaatggatggaaggtatgaacaggcaattcacaggaaaggaaatacaaatgacttttaaatatttgaaaatatgttcgatctcacttaaaaaagagatatgcaattaaaatccacccataaaatcgagaacaatttcaaagtttatgaacatactctgctggtgaggctgtggggaaacagacactctcatctattgttaggaggagtgtgtgtcactacggtccttttggagggcagattggcgtggcccatccagattacaagtgcaccctcctttaatctagcaatctgttcctaggaatttactgcaattgtatgtgtgcaaagtagcacttgtaactcagtgtttattgcagccttatttgtaacagcagaagtttgggaactgtccaggtgctcacagataatagagaattggtcacataacttggtatctccatgcaatggaaaattatgcagctgtaaaacaaaatgaccatactttccaggcaccaatttgataaaaacccctggaaaaatattactgaaaggaggtaatatagcatgctactattcgtttaagaagcaagtgcggagtgaataagaatatacatccacatttgcttctgtttacataaagaaaatttgaaaggctacgcaagaaattaattattaggactaattaactattaattaggatttttccagagaaacagaaaaaaataggaaatatatacgtacacacatacagtgatatagagaggggggttgatttattataaaggattggttcatgcagtcattcaattatggaggctgagaaatctcatgatctgccatttgcaacctggagacccaggcaagccagtggtgtaattctgtcccatttcaaagacctgagaaccaaagaaactaatggtatcaatcacagttcaagggcaggggaagatgagatgagatgtcccagttcaagcaatgagacaggaaaagaagggagaaattccttcttcttcttccttttgttctgttcatgtcctcagtggattggatggtgcccacccactttggggagggccatgtactttactgagtccactgattcaaattctcatctcatccagaaacaccctcacagggatacctagaaataatgtttcatctgggcaccctgtggccaatcaagctgacatgtaaaattaaccatcacactaatgaaagtggctgtggagggtggtagggatagaaatgagacttttccactatatctctttataattttaatttttgaattatgtgactgccgtgcctaattaaaaataaatgcaacaccttgggtgtgggagcagagttgccgtgggctcactggttgctgcacacgttgctctgcatgtcctgggttccttttcctctggttgctccttcttagttattctgggggaaagcaggtgccatggggtacctgagactaataaataaatgcaggtcagcttgtggcccacagaggatggcccagcaggcatggggtgctgtgtcatgggcaaggacatgggccattcttcagtggcagtcattttccttgatgggagcccagaagtgctttgggaaggtagcctcgtgctgggcgtgtctgccctaagttgagtttaccaacacataggaaggtctgaaattcatttcagcacaagagcagaactgaccctgtgtgcttacattggaaatcacagatgccccttccctcagtcaggaaaattacccaggtcacctctggtgagcagaaggccttgcagaacaagtgctcagtggacagtgtgacatatgagccccgccgggatctcccgctgcagcagcgaggaagtagtgtggtgcagtggttacgtgttgcagtttcagagctgagttcacagcatggctgtattaatctgttctcacgctgctaataaatacatacctgagactaggtaatttataaagaaaaagaggtttaatggactcacagttccatgtgactggggaggcctcacaatcatggcagaaggcaaaagggcacatcttacatggcggcatgcaagagagaatgagagccaatcaaaaggggaaaccccttataaaactatcagatctcgtgagacttattcactaccacgagaacagtatggaggaaatcacccagatgattcaactatctcccactgggcccctcctacaacacgtgggaattatgggagctacagttcaagatgagatttgggtggggacacagccaaaccatatcaatgccctgccctcttactaaacgtgtgaccttgggcaggtcactcagctctttaaccctataggttttgtcacctataaaatacgagtcgctagtacctgtctccaaaggtgtatgaggatcgggtgaggtaatgcagtgaagtgcacatagtaaccctaaccgtgacccgaatcaatagaacacttagaattatcacaaacaataataacagataatactcatgtagcatttactatgctgcagacactgttttaagctctccaactatatttactctccctgcaactctgtgaagtaggtattgtaattattctcactttacaagtgaggaacagagacataaagggtaaatgtcttgccctacattactcagctctgcactggaggaggtgggatttgaacctaggtggtctggctcagagactgcttttactgacttcatcactgtgttcagtgagttccaggacgtgagtttgaataaatggaaaaatgggaacctgaaaccctcagcaaagtctgctgtgagcatgtgtctctgatctttcaagtactgctttggccactcttaagcttcgtgaaccttattttcctcatacataaatgggaggagagtagtaatgacatctactatttattaatcacctgctgagcatcagaggctgtgatgagtgccttacaggtctcattttttcctcactggagccctataagataagtactgttttccccattttatagacaaagagactgaggttcagagaggcccagaaatcttaggcagccagtaaatgccagaaacagaagttgaagccaagtctgtttgatgccagagcctgggcccatcaccaccccctggactctgtgccctccgggagctgttgcaaagatgagagttatttttctgtgtggtgcctggcacacagtgccggtgtgcaaaatcaccaacgcttggattgtcgatgtaacatttgctcacggaaagctgacctcacccatgttgaagctccctttcctcatctgctgagtcaggatgcagatggggtggctttcagggactgctatacagacagagttctagaaggttgtgtggcccggaagcggtgctgtgccgatgttaggggcctctacctctgaactacaagcaaattctcccctccaacaagagcacattgtgttctggccccggtctcccactaaggctactttaaatgcagatccttctgccaacagctacttttagcaagggcagactatcataaggagagaaacttgcaagaaaatagcaaaatggaagcattgttcccgagggtttggagcaggctcagggaacggtggggtgggagagccctggagacgtgctttgccatcacaaataagttgtgcaaaaaaaaaaaaaaaaaaaagaagaaaagaaaattcacttaaagtttttcctgaaacctggaaggaggagagggcagacaaaactaactttggaaggatttaaactgctatagtcctgtggaagcttctctgaaggaactgggaactgtttatagcaggagaattgcatcttgaggctggagggagcacagggctattgatggatgagtccctagtaacacgggaagatgggaggcaggagaaaaagcttgtggactgagaaggggctttttttttgaggaaatttgtgttctcagggatgaactagggccatatgataaaagattgcaaggatggtttcaacttcacaccatttagagcctctggcactatgaggaggttggctcatgcagtagtgagtggactgtcctcagaagcatgcaagcagagcccgggtgatgatacagggagtccagctttaagataggacacaggacttgagcagaggctcataaacactgggccttgtgcagggtccgctctgtgccagctctcacactcatccatgatgaaatgagagcaaagaggactgaggctgggtgcggtggctcacatctgtaatcctagtgcattgagagaccgaggtgagaggattgtttgagcccagcctggccaacatagtgagacactgtctcttaaaaaaaaaaaaattgagtagtgagattttaatccaagaagactgttccttgagactacacccttcctaaacttaggtgttcaaatgctctttataaaatgacccctctgtaaaagcctggaaatattgggattagataatgtccaagtcttttccattgctaagattttgtgattctaggaaaatatgtttctgatttggatgaaacagaataggaggagcgtaaaagcaagcctaaaactgacacatcaagaaatggccatgtcagcataccagttagagatgcagagttacttaccaggaggaacagttacaagttgactgtggtcctcctgaagaacagggctggaggtgagattttgcataagtatcaattctgcattggtatataaattttaaaatgacatgcatgtactatatgacctttggttaacactaaaacttttaaaaaataaaagacaggtaataattatagctgccctttactggattctgtgctaaaggctttttataatattatttcctttaattaatcccatcttagggatgaggaaacaggctcagaaaggtgaagttacttactttgctgtgcagacagggtgaatttcaggtttttttgacgtgagaatccaaaccagatgcatatacacgaagctcagttgtcctctgccagggtgagacttctgtggggcttcaggagaggaagaggatggggggatgtgggggtaatgctatagaaagcaccagaagataactggaagagagatgatgacaaaaaagggggtcctggttaggtttcttgatcaaacatcttgaggaattcagcagcttgtcataaactaaaaaaaggcacacttgcacattaaaagagaaataattaaacagttgcatgagacacttatgttcctttctcccctcaatttggatttgatgggagggaggccacatgggaggaagcaagctgtttggacgcgttgactctgtgccaggcactgtgccaggaaccttatggaaatatcagcccatctagtcttcgccatgactctgagaaataatattaaccaagaacgtcacttaggaatgcctaccgtagggtctctcagcttcagccctgctgatatttgggaacagatcattatctgttgtgggaggctggcacccattaggtgccagtgtgataaccgaaaacgtctccacacattgtcaggtgccctcagggagtcaaactcacctccaattgagaaccactgtcctcagatgactaggcatgtcatatatattatcttgagtcaccctgccagctagctgtcatgatgcccactttgtaaatgaagacactgaggctgagagaaggctgacatcattgtcagtagcagggctaagaactgtgccacgtgttttcaatactgaatttagagaagcagcaaatgaagaccccggcccagttaaccttgggctaacactaaaatatagattgtatcttctcttttttaaccacagtgaatgtcttagaggaggggctggtgtttcattatgttttgtttgtttgtttgtttgttgtttttaagtacgctggcgacatggcacaggctctggaaccaagcaccttcacttattatctctgaaaccctggcatgttacttaacctctttggctctcagttttcttctctgtaaaatggaactaatgattatacctcctcatagggttgtttggggatgaaatgagatcacgtgagcgaagcagtgcctggcagatagagactcagcatcaacaaatgtgagctgtcattcttacgagcaagtttttaaatccatttcacatactcagacctggaagtggccccagtggcatcattcagggcaccatctctggggtggctgactctgcttctttgcagtcaagcccaggggttgtaattcatgtcggattttcgctgaccactgagcaatcccctctgggctgcaggagtagccggatttggcttgagcgtccagaggagaagccgtccaagctgatcaagcatttgccttctccaccaataggagtctcaggagaattatggaactgtctttgcacatggaagagattaattcgtgtggccacaaatagcttgaacactgtgtcctcagcgctgtgatctagtatcccctgaaatttacacagggtgccagcccggcagccagaaaagccacaggaccgtcttaagctgcccagcgctcctagccgggggacccctcaggaatttcagagggtggggacaagattaagtcgtttgtttttcatttcatccacctacctcgccccccgcctaataagcctgctttctggcctcccgtttatcagccaaatggaatgattgtgcaccccccatccccgggtttgcacctccaggctcagtccgtctacttcctccacctggcgtaccctcttttatggtcatgctcaccttccagtctctgcatagctaaatgccaccatcctccaagcctagtgccaccacctctgctccccccaccaagtggtacatggctttaaaggatgtgggctctggaatagagtttaaaccccagctctgttagatgtaggtgaggggtgatatggtttggctttgtgtccccacccaaatctcatcttgaattgtaattcccatgtgccaagggagggacctggtgggaggtgattggatcttgggggcattttctcccatgctggtctggtgatagtgagtgagtgttcatgagagctgatgctgttaaagtgtttggcactggccaggtgcggtggctcaagcctgtaatcccggcactttgggaggcggaggtgggtgaatcatctgaggtcaggagttcgagaccagcctggccaatgtggcgaaaccctgtctctagtaaaaatacaaaaaaaatcagccaggcgtggtggcgggtgcctgtattcctagctacgtggatggctgaggcaggagaatcgcttgaacccaggaggcagaggttgcagtgagccgagatcgagccactgcactccagctgagcaacagagtgagcctctgtctcaaaaaatattaaaaaataaagtgtttggcagtctccctcaccacgaccaccccctctctgtcctgccactgtgtaagatgtgtcttgcttcccctttcccttccaacatgattgtgtttcctgaggcctccccagccacgcagaactgtgagtcaattaaacctcctttatttataaattactgtctcaggtatatctttatagctgtgtgagaacagactaatacaaggggcttactttcctgtgaacctcagtttttgcccctataggtggaatactaatggctgattaattcctgcctcatcagatcatttgagatttaaaccagaaaaggcagactaggtgcttggctccctgctgagaacgtagtaaggactccctcgatgtgagctcagggcaggtcaggcaggtagctggcctagacagctggggcaggaggagaacatccgtgcaaagaggctagaggccctcagcagcagcgtggtggcagctgttggatcggctggccacacttccacagatctggcccataaggagacaacactccagatggatgtaggtgggttcttacttcacagtgggcaagatcaggttggtgttggctcccacatcctagtcccacagggtgaccccaaactggaagggccagacaacagatggcatcagtggtgggtcactctgttattgaggaagcaactctggacacagctaagtggttttgtagtcttcatctgtaccaaagtggggcaagatggaaagcgccaagtctcactagaacgagggaggccgatgagaaatgaccgtgctacagctcctcacaggactgctgtcttgcagcaccccacgcaggatcctagggccttccgtcaagatttgggttggactgtgctttagtcttgcctatggggcttttgcagaaatacacaaggtcaccggggcccagagagtaatgagagaggcaggaagacatttgtgctcacctagaacagtgcctggcacattgtatatgctcaattaaaaagtgttggatgaatgaatgaatttaccccacagtatttaacaaacccctgcctggagcaggccctgttctggttgctgggaatttggagataagtgaggcttagcccatgctctcaagacctcacgtgacagtgccagagatgcttcaactgatcattagcaaagtgttctgagatctctgaaaaagctaagcatggctcggaggcactgacagtggagtgtctgcatttatgagagcattttgggtggcaattggcagaaatgtcaaagccgttgaaacaaacaaaagaaagagacttaattggctcatgaaactgaaatgctacctgcaggcatggctgtatccaggcactcaaacaacatcaacatagtctctctctctcaccccgtccccactcacccatgtctcttggctctgttttcctctgtgtcaccttcctcctggccagcttccttgtcgtggtggtccccagcccttctaggtgttcatcatcctgaggactggcagtggcagcagaaagagggctcctctttcccagtagctctcccagaattcaaggattgactcaaactagcccagttaggtcgtgggcacatccctccacaaatagcactgtgggacgcgaaagtgatcagctccatccaaaggatgtggagggagggtgaagcgggagaggctctccaagggaaagtgaggatgctgctagggaagaggaggtggatgctgggcaggtacagacaacagatgtccactagatccacctagaagaccgttcattcaaacttgattatgtgcactgggtggaaatttattggatgggacaggggaaatagaatgggaggaagggaatctctggcagagagaacagcatgagcaaaggcccagagggagagaagtggatcacaaggaattggaccaggagatgggtaggtggttgaggttggaggattgagcagaggccagatgattgaaatccttgaatgtcaagtgattcaaagaggaaagagctatggttagatttgcatttttaaattcattcatccaacacatatttactgagcaactactatgtgaataagcaaagtccctgattatattctaatcataccctagggtagtgctaggaagcaagactggagacgctgagtctggaggcagggagagggaggaggttgcgcaccagtctagacgggagtggctaagacttagctggggcgtggagcacatttcccctgcatcagctctactcagggccaaacctttgctatgtagagtgagtgcaggaagcagatctccaggctcttgtgtgatgctccaccagggcagcctgctgggaacatttttgtagcatctgtttgcacaggctgtcaccaacagaattagcctagatttgaatccttgctgtcccatgcactggctgtgtgacctgccgcacctctctgggcctcagtctcctctgttaaatgactttgtgctggcacctactttgcagagttgtcatgacgattaaatgggatagtgtttggcgcctaagaagtgctcaataaatgacgatgttattaattactattgttactgtgactgtcttcaagggacatccactcctgaaactcatcttcctctcttggaaactgggcaccatgatagcaagtgccttagtggaatggtaatccacttagtggccatgtgaccttgtgcacatgacgtcacctctctgtgccttggactcctcatgggaaaaaatggggctaatattagtacctgcttacagggctgttatatgaattaaataaatcatggtaagtcctgaggagagttcctggcacgtagtaaactctcaataaatgtcaaataaataattattattatgtatttgtaatattatgttgcaatagttcgttatattaatataatatgttataataacatagattatattatattgcaacatcataataataagtattattattcggtagtagtagtttagattgaccatctgcaatctgaaaatctgaaatgcaaaatactccaaaatctgaaactttttgagtgctgacatgcggctcaagggcagtgctcacgggagcattttggattttggattttcagattcagagtgctcaactgctgagtgtatatataatgcaaatattccaaagtctgaaaaagtctgaaatcctaaacacttccagtcccatgcatttgggataagggctggtcagcctatagtatgttattaacaaggaggggttaatgatgacatttaaaaaaagccttattaggccaggtgcagtggttcacgcctataatcccagcacttgggaggcctaggcaggcagatcgcctgaggccaggagttcaagaccatcctggttaacatggcaaaaccctgcctgtactaaaaatacaaaaattagctgggtgtggtggcacacgcttgtagtcccagctactcggaaggctgacgcaggaaaatcgcttgaacccgggaggcagaggttgcagtgggccaacatcacgccatggccctccagcttgggtgacagagcaagaatccgtctcaataaaaataaatgaataaatagcccttattaaatggctgttctcagaatcatcatcattatccattagacacttagagggaaaatgactgcatttgggtttggggataaaagggccaccatttcctcccacaaaggcaggtgtctttctctcagaacacgtggttattaaatattgctgttattaatattgtgaaacgacatcagactcaaacccttctcccagcagaacaggagaaggaggctggctcccctcccctgatctgtttctcctaggctgaccggaggggtgtcccgtcccccgctttccctcgacggttctgtaactccccagaaggccatcccagctggcactttagttttgcgattcggggatttcttttctgcctcatgcctggaataatttgtggctccatttacaagagcagagcccttgtgttcaagcccgctcgggtcccagaagcagtgatgcctggaaagcagtttggaaaggtcagctcggggcgcagtccaaagtgattttaagtgccccagctaagtgccggccagaatggggagcgcttttaatctataagccttgccctgtgaagaaagagacaacactgctctgaagcagtttgactgcaaagtaataaatccctttgtgtatataaaaagtacagacgtatctagctcacatttcagaagaaaaaaaaatctctgcagttagggcattggagttgaactcatgtacatgaatctatgggaggaacttcatcgagaaaaaggagtttataatcgtcatacatttttaatttacaaggatttgttctgagactgcctgagatcacagtttcctaagctgtgtgtccttgagccagttgcttcacttctctgtgtctcatctgtatagtgggaagagtgagtactcacttttgggttgttgtaaaaattaaatgaattactagctgtaatgcatttaggatagtgcctggaacagtgtacacacttaataagggttagttactattatcttatagtacagatttttgttttaggattggcggcgattttctgcctggcacacaggaaagccagtctacagagtggccctgttgtttgcaacagaaacctataattgtctgtttctccttggttttctgggttgagagtccaatgcacacatttcatcatgccttgatttttttttttttttttttgtcctttttaaatccaacctttcaggacgtacttccagcaaggcaatttggaattcttgaattccagagagacctttccggccacattagctaacagaggaacttttcaaaaccaagagaagcttgcaaaccactggttagaaaatcaactcattcattcattcattctacaaatatttcttgtgggcttactatttgccaggtctgcgtgccaggctcaggggtttcaaagagagcatggcatattaaaggtgtatcctatggggagccaggccctgatttaagagctgtgtatacatcaatccactcaccacaatcctatgagatcgatcttatcttatccccattgcacagacgcagaaactgaggcaaagagaggttaagtatccctaaggacacacagctggtaaataaagtccagattcaaatcgaggcagctcagctccaaaatttgtactcttctctttttctccccagctctttaatttggaaaatttcaaacctacagaaaatgtaccagtatggcacagtgaacatcatatatttgtgccattgacgtagtcattgtttaaagcttcccacattttctttaccctttcctttctctgtaaatttttgtgaaaccatgagagttacttgcaaacatgatgattcttcaccccaaaatacttcagcatgtgcagtagtatctattactgcataacaagttaccccaaactttaatagataaaaaaacaagtatttattatatcatatctgtaggtcaggaatctgggagcagctgagctggtcctccactcagggtctctcatgaggctataatcaaagtgtgagctggggctgccttcacatcaggcatggtggagctcatgcatgtagctgttgattggaggcctcagttcctccccacataggcctcttcatggggctggggctgctcatgacacattggctgacttccctgaaagcaagtggagagagagagaggaagagaggaagagagggagcaagaagcctggatggatgccacagtgttttatgtcagtgtttatgtcagagtgacataccatcacttctgccatattctattggtcacacagaccaacccaggtactgtgtgggaggggactacacgggggtgtgaagaccagggaggcagagaccactggagtatcttggatgctggtgaccacagtgtgtttctctgaatgatgaggacattctcctacaaaacaaccgtactatgaccacacattaatactgtactactacctaacattcactctgtattcaaattctcccagatgtctcaataatgtcttttttaatcagtctagatccattccactttcttgacataagaacaggttgattgcccttttgggaaacactccttccccactctcagtccacctagttcaggaggggccaattctgatgccccagccatgggtaggcttatggctcagatccagctagtgaacactcagcattgccctggtgacagcgattggttcagggatcagcatgtgaccgaagctgggccaatcagaataattcctgaattttagctgggactgttaaggaaaaggcaccatctcaccactagggttgcagagctggtagggtcagattaaagacactgggagccatcttttctagcagcttgcaggagaggcttcctgagaatgaactcaaggtggtagaaagcaaacctgagtgatagagatggggggaggggagacaaagagagataatgactttatttttatttttttattttttttcaaaaatcccttgatcaagctatgtctgaagctaactacccctaggggttccagttatgtgagtcaataagttcccctttttatttaagccaatttgagctaaagttcttgttatttgcaacagaaagggtcctgactaatacatgcatcttccagggaaagaaaatgacttactgtaaatccttaacacagaaactaatttgcagtagaagtgtgctatgaggaagcaggactgatattcttagaaattagagttgttttgtctcctctatttgtaagagtctaacagatgacacagcaaaatctccagccctcctaccttccataacgggtttgctcatccatggaagttcatgaagttccagttatgccacttattactgctgtgaccttggctaagtcatttaacctctctaagcctcagtttactcatctatgaaacagatatattattaagacataaaataaggggagagtaaaataagatagggcatgttaagcatagggacagtactgagcatatagtaagtgctcaataaaatgtagccattcatagcagttctaagatgaaaaacctactacgtgcgaggatcttgcaaagatacacaagaaatataataggcctacctgaggatgtcagaaatcttcatggaggaagaaaggctcaatctggcccttccaggattcactcaaatttaaaaacataagcagatgaatagaggtgggcttcctacaaagaatgtgcaggaacacaagtcaataataagaacagctgagatgtattgagcacttactgtgtgccaggcatagctgtaagtgcttttcacacatcaactcacataatagttgaggtcctcccagcccttgaggtggggattgtgatggacagttttgcagacaaggacacagaagcccagagaggtcaaatcatttgctcaaggtaactctggtcctgtgtggagagccaggattcagaccccaggtgcctgaattcagagcccgcatccttaactgctctgccaacgctactgttgcttataaaacgtaagtgataacaacgacggcagttacagaggccacatatctatgccacagatacaaaacccaaatgatatggatatcaaagaaaaggcacaaaggccacccatgcagccaggaccaaggcccaggtctgtgggcctcttgtccctgaggggttaaatgttctgttctgtgagagtggccaggaccaagcacagcgctccgggagggaaggtgacaggccagctcagggcggtggccaaagctccaggcagctggtggcatcgggggctatggccagctgtctcctgctgaccaggcctgagcacccccaggcctctcaccagcaagacctccacagctgtcagaggggaacagtgcttgccatccacgggcaacccgcagaacggggccagtgaccccggggtgaaaggtttgcctgccgggcccctagcctcctgactccatctgtctcgccacctgcaagcaccatttctgactttttcctttggtataaatggggaggcaactatgaaatcaacagtgggaaaggtgcaagaggccccatcttcccagagcccgagcctgctggctgttgagacgtataggctgagaaggctggacaggggacgctgactaggggacccccgtgctggatggtgccatgggtagggctgtcttggaatcccacagacccacattcaaatcctggctttgcccctaagagctgcctgagctcaggtgagccatgcaccctatcacatctctcctctgtaaaatgggcacagcccacctcacagaggagctggaaggatgtaatgaggtgccttcagtttccctcaaggtctaggagggtgttaagtccaccggaagtagaacgaaactcctaagtcgattcccggctcttctgctcctcagctgtgtggcctttcatagcctccttcatctttctggggctcagtttcaaaatccgcaaactaaggggcatgatatccatctgacagggttactgtgagaaattcaatgcatttctatgtgtaaagtgcctggacttcagtaaacactattaaaagaagcagtaacagagtggttaaaggctctgacatttacctgctgtgtgatgttgagcaagttaccttccctctctgtgcctcagtttcctcacatgtatcatggagatactcatgcccttatcttaaaggcttgtcctgagggttagatgagacattataaaggcctttggagcttagcaggtggcgggtacatgatagacatgggttcttttttcttttttttttcttgagacaaagtctcactctgtgatccaggctggagtgcagtggtgccattatagctcactgtagcctcaaactcctgggctcaaggaactctccaacctcagcctcctgagcagctgagactacaggcacatgccaccacctagctaatttttaaatttttttgcagagatgggatctcactatgtcgcccagctggtctcaaactcctgggttcaagtgatccttttgcctcagcctcccaaagtgttgaggtcacacacgtgagcccctgtgcctggcctagacgtgggttctgaattttacaaaagtgcttggcaacgaatgttactgagttcttattagtaacatgttttctgttactagccctcctcaccaaggagtgggtggtggacaacctaaggaaagatacctttttattttattttattttattttttactttttttctttagacaaagtctcactctgtcacccaggctggagtgcagttgtacaattacagctcactgcagccttgacctcctgggcttaagtgatcttcccacctcagcctcctgagtagttgggactacaagtgtgcaccaccacccctagctaatttttgtattttttgtaaagacagggtattgctgtgttgtaccatttttagggggggaaaactctcttagagaaaagatggggaatggggcaagaggtctcctcacatttagagacatttttgtgtagttgtgtagtgtgggtgccatcctaaaagggaacacctcaaaagcctccaaagagagttatgcagatgtgacttacccacatggcccagctttcgagggatcacacagctgggctctggagtggatctgtgtcccttctctgactctcctgtgtgacttgggcaaggccagccacttaacctcaccaagccaggtcccatcatctatgaaatgaggacactgacagacctgcctcattgggagggttctctgttttgttttttgtttgtttatttgtttgttttgacagggagtcttgctgtcgcctaggctggagtgcaatggcacgatctcggctcactacaacctcctcctccccggttcaagcgattctcctgtctcagcctcctgagttgctaggattacagacacgtgctaccacgtctggctaatttttgtatttttagtagagacggagtttcaccatgttggccaggctgctctcaaactcctgacctcaagtgatctgcccgcctcggcctcccaaagtgctgggattatgggcgtgagcctgcgctcccggctggttctctgaattaatcggtgcagagcagtgattcccaaccaggagtgactctgcccccgaggggacatttgacagcatctgtagacatttggctgtcacatctagaggggaggcgtgctgcgggcgcctagtgggtagaggtcagggttgctgccaaacatcctacgatgcacaggacatcccccaccccgcccccagcactcaccaacaacaaaggaccatccactctgaatgtcagtaatgtcgatagacatcctcacgtagagtattggcttcagcatagtgccagtaaaaggaagtgcttgtgtttgttgaatgactaaatgaacttgctcactgcaagtctcagcttctcctggcatggagaaaatgtatctctctcccagagttgttgtgagatcaatgagaaatacgccagcctgagggcctctctggggccctgggaactgctgttggatgttgaatgaatatcatagcaagggaacattcggagtctcagatctgggatttgggcaggagggttcacccaggaggccagcttgcctgtgtgtagcatgtagttcttccagctgaaactgtttctccctgaaggatttcaagcacgacatatacccaaactaaagaggatggcagcaaaacgtgcagaaggaagctaggttggattcagcctccgtgctcccgccttgctcatctccaaagctgtaagaatttaagggaaacttaccccatgttttgttgcctcatttgtgcataattcatcaaaatgctgttctgtaaaagaacttctctgtggcttgaaaccctttgcacacttgtatcttttcctgcgctctctttttcttttatatctctccctctctctccccctttctttctcattaaaaagatgccttttctctcaagtgcaagaagctgacttgtgccaaaaacaagcagggtggatgctgaaagttcccagggttagcctggagcctcccaaccctagaccttgagcaacctcccagcttaagtaaaatcctcctccctgctctgctccccctggatggctctggggagtcccaggaatggccaggacagagggagccaggtgagggcctggctgctcccaggaaagagaggatgtcatggtcctgttttggccaagcaggtcctgttttggccaaccagtgctcccgtgcgcagatccctgtggtgatgggagacaattgcaagggtcagggttcgagacaagatactcaaaagtcccttccagtggtgggcacctgactccagggcgggttcgtaagggctgcggtagcttcggggcaggtgcagcctcggtctcctcacctgggcagtgggaataaaggggtctattcagattgttcggatgagcagtcagtgaggaggaggatgtgaggtgtgtgggtgctgggcactacaccaagcactcagggcatgcaagccaccagtgtccctgcatcttcagggcactttctgaacctcagcaccttcctctccaaaatgagaaaaacagcacccgctccatagtgttgttgagaggattcaacaagctccttgctacaaagcccccagtaggacctggcatataattcctgttttgaaaatgtttgtgtatgtctcacatcttacctaattcatgcccctgcctgctcataccaagaacaggtatccagtaaaaagggagaagagtgtaaaaggtgaagatgctacatttattttttcctggcaattcatttgattttttaaaaagaggccacatgttggtggctcattcctacaatcccagcactttgtgaggccgaggcgggcggatctcttgagcccagtagtttgagaccagcctgggcaacatggcaaaaccccgtctctacaaaaaatacaaaaattagccaggcgcggtggtgcctgcgtgtagtcctagctactcaggaggctggagcaggaggatcacgtgagcctgggaggtagaggttgcagtgagcctagatcaagccactccactccagcctgagtgacagtctgggtgacagagtgagaccttgtctggaaaaaaaaaaaaggttgcagttcgcaataggaaggtcctttctttatttgggtagccttagcctcgctggacctcagtttcctcatctgtaaaatggggataattataatacctgcatagcagaggtattgtggattaaatgagagcttttgtataaagtacttaggacagtgcctggcagttcgtaagtgctgttttaagagttcgccacattcagccagagtggacagtagactgaccgatttttagaaagcccaaattccctgtgtttaaccagctctaaaacatctcaggaacctaagcagcctctcttgtacctcaggtgtttctgtcctgtgaaaaaggaatgaatttgctggccgcctatggagttcccacagttgcgctgcttagtgtttgctaagccctcagagccctgcggaaatgcaggctgctacaaatgctattaccagaatccacattccccagagctctttggagatttgggaagcttgggtttgtttggacttttcatgactcgactctggtcatcgttagggcgtttgatgatcttagacggaatctgcctttcacctctgtggcctgctgggcccttctgggcgtgttacaggaagggaatgcatcattgctcctatctgcctagtcagcttttgtaacaagctcttgatatgatgattttgtgcttgggtaagcttttcagaccttctgcggctctttgctgcagaaggtggaggtactgggacaatcaaatcaagccatcagctgttgacagtgggcctggcaaggtctcacggtgcagaagacactgagctgtctcacgctggcttgcagtttggtatgtgggatccggtgtgcctgggatgagagcacactcgcaacccaagagggtctgaaaccctaagcactcttcgagggtcttgagaataagtactgacctcaggatctgggtccctttcccagtgggggttagagtctcagtggccttggttgtcctcctccagtgcctgtttatatttgaacttcttcctcctctggacctcacccattggatccctgcaggattgctggaccctctgccaagactggccatcagcgggagggctgcttccctccctacttctaagctcaaagccctaggaggtcttgcccgtggagacgaggtacatggctttgtgttttattgccatttattgttcttgttattttaacatttatggagcacgttttagctgtgaactcatttcttgagcatcactgcggtcaaaatctccccagggtgcagggccaagggttactttgattctttttttggctgttgccctatttactttattaaaaatatcattgtgcgaggggctccctttgttctaagaacttttctggacatgaccctgggtccaccctaagcccctgattaccatcatttgaacatgagcctgggtatgagtaaggccatataggccagcggtcagcaaacattttctgtaaaggaccatgtcataaatatttttggctttgggggcctctgctgtaactactcaactctgctcttatcacataaaagccgccatagacagtatataactgaataaaactttatatacaaaaccagacagcagccagaatttggcccatgggccatagtttactgactgccccctccccacccacccaacgtagatgatggggctttgttctacgaactcccttttagttcttccatagatctaaagagtcagttcttcttactgcagttttggcctgtttctacttctttgtttgatcccctagagcgtgagttggcaaactgaggccaacagctcaaacctggccagttgcctgttttgtaaataaagttttattggaaagcagccacacccattcattctgtgttatctatggctgctttcccactacaacagcagagctgagaagtggcgtcagagacctcttggcccccaaagcctaaaatatttcccatctagctcttcacagaaaagcttgctgacctctactctaaagagttgaggaatggctggctgagaagcagacttttttttgcatgtacatgaagagcattactaaccctcccaaactcatcttagaacttttctcccaggttctcttgtctagtctttcaaatattttagatgttattctctggaatctaagtttttttttttttccaaagttccagaccactgtttttaaacaactttggactgtgatcctcataaaggacatattttatatgtcacccctgtaatgacatacaataaactgcatacacacagatgtccccaccacacacacaaaccacacaaaacacatacagaaatgaaagttttaagaaacaatgcttgccttactatatgtgataagctctcgtattttctatgaacaccagtcaggatcagcttgatgatgctgtggtaacaagtaaccccaaatctgagtgccttaaatcaacagacatttatttattgctcctgctccacgtttgccctggatcactggggatcctgaaggagcagaacatcacacactgatctccaagtgtctgacaagagtggtactcaccatttctttgaatatttctttggtcaaagcagctcacatgaccataactttcaatagagtgaagaagtgcagccctactgtggacccagaaggtgaatctgagatatttggtcaacagcattaagataactaccatatggctgggcatggtgtctcctgcctataatcccagcacttttagaggccaaggtgggaggatctcttaaagctaggagttccagaccagcttaggcaacatagtgagacctcatgtctacaaaaagttttaaaactagccttgcatggtggtgcatgcctgtagtcccagccactcaggaggctgatgtgggaggatcgcttgagcccaggaggtcaaggccatggtgagctatgatctgcactccagcctgggcagcagagtgagaccttgtctcaaaaaaaaaaaaaagaaaaagaaaaaagaaaacaaaagaaaaaaattactaccatattagtctatcccaggagttggcaaactttttctggaaagggccaaatgctaactatttttggctttgcgggccataccatctctgtcacaactattcagtgcagcagttgtcacgtaaaaacagtcagagacaacatgtaaacaaatgggcttatctgtgttccagtaaaacattatttataaaagcaggcggtgggctgggtttggctcataggctgtgggttgccaaccctggtctactctatttcttttttgaaaaacactggtcacagctcactaaactgattttattaacccatctatgggtgagactctatagtttgaaaaccccaagtgacgataagctgcataagatgagggactaatatttcttatcagctgtatcctcggtgcccagtacagggttagtgctgagtaaacattgttgaaagaagccactgaaaatcctctccaactgtttttctggtgataaatactctgttcaagatgcatacgttattgtgtttctctcgtaaggttgcctggaaaaaaacaaaataaaataaagctgcacacattattgtttaattcgtaaaaggttgaccctactttcaaggtaactgtcagttccaaacttagagacacaagtattatgttcacttctctaagagcactgttcttcattcaagcttgagatgatcgctccataaatgtagtgttgaaatctatacttgtggaaacccaggtcattgtatatctgttttcttcatatatatttattatttattgtgtcagggaaaatacatgcactatctcatttaattttctcaaaaattgcaggaggtgggtgctaatgttactcgcattgtacagatgaggaaactgcagctcagaggaatatgcccagtgtcttggagctcaagactggtagagatgggattggagcagagtctctgactccagaatatggggtgtttgatcatttggctatggtgtctctgggacatgccaccacataccaagacctactcaagtgcaaggtctttaaatgctattggcagttgaggccatgttttaagtcctcttagaaagacactatattgtgcttcataagatgatacaaaacatacatgagccggttccttttatgggaaaatctgaagttaacagtgagattggggagtggggagggtttaacactttaacagctgtcctgctaagtgtgagagtaagtcaggccaaacctagtctcacagtcaagactttcaggtaaaagtaatagagaactcaagtcaaactggttcagcaagtaaagagaatttaggggatcaaggaactgagagtccagggtcagagctcagttcaggtatagctggatcagggttgctgatgcagtcaggatttcagttgttttctgactcttgacttgttttgttcttctccacgttttgggtttaacctcagcctgcacatggagctagatggtggggtaactgagccacaccctctaaggcacatagtaggtgctcaccaaatatttattgaatggatggactgctcaagattggcttaaaagcttgatacttttatgtagctgttaggttggtatgcattttaagatttgtgtgtatctgtctgtgtgtagcccagaggttaagagtggaagcacattgctttggttgcaacccttggctgtgccacttacccactgtgtgacttttggcaagggtcccaaccccagttctgcacctgcaactgccctatgaagtaggtagtatcattttgcatctatgatgcacaaggatagcatgacacaaagaggctgaggtgcttgcacaaggtgatttatggagctgggtgtgcaccttggcattctggttccatagcctgtgtttttctccactgtgcatgcaaagtgctcaacacagtgcctggcacagagtaagctcccagtaatcaaaagagccatcaatccaggctcgtttaaaggtggtggtggacagggcaagggtttctcccaggataacatgtagtgaagcatggagttgagtgatataaaaaataatcactttcctagagtctgggagaactgaattattatttcccagctgccactaatctgcagggggaccttgcagcgatgttcccctctcagacagagactcaattttcacaaccataaaataatctaaggagtctcaagtacccttctagccctgatattctaagagtctgtgacttgatgatgcctgtgagtttggaggtctcatggctgggcactgagtttccaagattgcacatggtttggggtgctggagctgtggggaaatcatgaggagtcactctgcagcatctgttccctgctcctccttctgggtgctcctccaccaaggggcaggaaagcccaaactcccttgcagctaggtttctaggagtaatggaacattaagcaggcacatgcgcttccttgaaattcagaaggcggaggtcgtactcaaattgcctctgccgtgttggttgtttctgtcactgtgcagagtctggagtagtttggcttgctgcacagctttagcagaggccccagcgagcaggcactagctttatgtgtgttgagaggcatggtgtctttgtgtgggttcccaagaagctgacctcaagatcagggctccagtgccaatagttcatttaagaggtgactccaagaaacaccagaatgggaataaagaaggaaggcatgaagcgaaggaaagtaacagagggtgtgtgatccagcaggttactccctgagcatctaaggctacaccctgatgggaaagggcttataacacgtgccgctgagtaatccctccttaggggtgagggagctggggtctttataccccacatatgccagaaagagccttcaggtaaaacattgcacttgctgccgtttggaagttggatggttttcatggaaatggtatttgccgaagggatttaggcaaggtagtgacagcatcagccacgcagggcacagggcatccttgttgcttgtaaggattctggcaagtgtgataaggtcatgaggctggcacattagtggaatggtttcctgatagagatatccacaaggtgcctatcatggagggattttttctgtaaccagcagctttctggtcacagcacatgtagcagtaaccagttgtctggtgtcgctttggcattccctaaagcttatcctagcgtctgtgcccccaacctccccagaaattctctaagtcgtttgctagcctgaattaaccccttcctgcttaagctagctgtagtgggttctaccctctgcaactaaactctggttgataccagttataacctacatcctgggtctgctggacaagcagaagagtgccagtcactgaggattagaacaaagttcccacaacagccctgaagggcaaccgggctatgcacttctacatcatgggccaccagggagctgagtaataaaaccactctcaggcgtcagaggactcagattcttgtcccagctcccccactaacctgctgtgggaccttatacaggtaattttcgtcatctgaacttcaagtgactaatctgtggcccaggcaggagaggatgggggcgagagtgtggatttcaggatcagatgggccaagttcaacctctcagagcctaagttccttcatttgtgaaacagggataacagggttcccagagaaatattcagaagcatcagagcctctctgaagaattctgccacctcctgacattgtcagtttccctctctccctcttccttcctctctcttaacaaatatttattatgctcctacttataccaggcatgactattggtgttgaaagcccacaagtctctctttctgtgaatcatagtttctggagggtagagacagacaagaaacagacaaaggcacgtgtgtaatgaatgtgtccgggggtgagaaatgcaatggagaagaactccgccgagcaatggggcaggagtagtgagggaccctccttaaggtagggtggtcagggaggtctctctggcagaggcctgagaggggcagggagagccgtgggcatgtctgaaaggagagcatgcttggtgggggatggggcttgagggaccaccactaggaggccagtgtgagagatggagggtggcgggatctgagctccagaagtcaggggcgggatcagacagggcctcatgggttgcgcttggctctttagattttactctgagcaagccagaagctggcctcatttaacctccttttagaaatcggtgtgatgaatcaatagctttggccgtttgttcatcagtcattcattcattcaacaaggatttgttgagcacctcctttgtgcagctctgtgcttttctagttcctctgctgaacagtgaagggcagagcaagcacccaccggaataaggagggagttgggcattttgctagagctcctgtttggtccagaggccgcacacaatggaaaagtaaagcctggtcccctccgcaggccaccccgcacctggaggcatcacctggagctcttcctggcaggctgaggcctgcgagttcagccccactggcttccccggggcaggggttgcccacgcttgctgaaataagaacctcataccagatcagccccgcatcccaagcagggcaccctaaggatgcttttatgtaagaggttgcattcccaattatcttaagatgcaaagtgaaggtgttttgcccagggaaactctctatcaggagtcgttgcacatctaaacacatgaaaaatgagacttcctgaaacattcctatttcaccctgtgacagttttgcacagctcatagagttcaattttcaaatgtcatcccactctgagagacccaatatttgaagtcgtggaaatctatctttaaaaatacttttaacagcattattcctaatattaaaacttggaaaacacgaaagggagatacttgagttgtgatcatagcaaatgttcctataatatttagtgtgtgtcactgatgctttacatattctaattcgtttcatcttcatgactaccctctgaggcagatgtactgttaaccccactttacacatggggatgctggggtctgagggcttgagaactccgcgggttaacccaagagttatgggacctggttatggaacctcagtgctaaggaaagtgacaccatcataggtagtgttagaacaaaatcttggggaatggttatgttttcctgttcggtggaaaggaagcatcaacatagaagattaggtaggagctcatgtacactaaaaatgaaagtagattagaatgagccgggttggaagtgggagaaatgtccccaaacacaggtttagagttggccttgagaacatcagcggtatggacagatgtacggacactggggcctgataattcttccttatggcgctgtcctgtgccttgtaggatggttagcagtattcctggcctctccctccccagttcctctccctccccagttatgacaaccagaagtgtctctggacattgccaactgtccactgggaagtaaaatcactgccattcagaaccaccagcacagatgctaagatcatgggtggcatttttctttcctttttcttttctgtggtttccaactttccttgaataggcatagatcgcgtgaataagtaggagcaaaggagctctcgttgggatgaccatgccactctcctgttcagaaccttccagcaaattcccaatacacttagcttccccagggcctacaaggccctgtgtgagctggcccttggctacttcttggacatgttcttctctccctgtgaccctttctcatcatgttccaaccacacgattcttctttctgacattcagacacatccagctcatttccatcccagggcctttgcatgtgctgctctgtcctgttgctctttcctacctcctcttcacatcacttgctcatccacttcaggggtctgctcaaatatcacctcctccgagaggccttccctgatcaccctgtcatgaatatttaagcgcctcctgtttattgtaggtcacccctactagagcatcatctccagggggactgagacattgtttaatttgctgttccatgcctcactcctagaacaacgatcggcacatagtaaaagttcaataaatatttgtggaagaagggaaacagacagggaggaaggaaggggggcaaataagaaaaataaaatcggtaaatttaggagcttacagtaaagaagcaatgtctcaacccacacagctgtgtttctctctaaattccaactcattttgacttgtggtttgtggacaaaagatttgcgtagcacgcagtctcctggcagctcgctctctttgagggaacacactaatacagtttttatgccacctctctccacaaataccatgccgatgagtggccagtgtcaaaacagcagcaacaacataaacagatgctccttcctttcagccgagcaagtgaagaaaccctgtgcgtcattcctcaaacaccaggagatgccaccgatagccacctctcctcacagtttcgttctgctcgagactgtgagttcatgtcaaccctgagctgcgtccccagggaaataggttctgctaacagtcagttcttactacgaggcattctcagagccaaggggaagctgggttggtggtctgcagctgaaaatctttggcagaaaatttactcgaggtttttcatgtgtgtcatttgccttgattttgggagtagggaagaagcactatcagtatctttggccattcgtaaggtcaaaatggatgtcggcacgtcctgcaggccttttctcagcctgagttgatttcctggtgcttgatgggtgagcagaggaaggcaggttttcattctcttctctcttctttttcattcttttgctgcattattcatttccttccacactcgttcatgcagtcatttttttttttttttgagatggagtttcactcttgttgcccaggctggagtgcaatggcgcgatctcggctcaccgcagcctccgcctcctgggttcaagcaattcccctgcctcagcctgtagctgggattacaggcgtgagccaccaggcccaccgggcccagctgtcattatttatttaatgagcacctactgtgtgtcagccaggcctcacacctggcacttagagaatctgaataaatataaggaccacttttatactcaagaacaaaggccacctcaccagaaacctctacacactttggggttcaggtttcttgtgactttcttttccttttttggtttcatttttaattacaaaagtaattaacatgcttatcatagagcaataaaatgatgctgaagtatataaagtaaaaatagatcttttctgacataacccctgttaattgttgggtatatacccttgcagacatgttttaataaatataaaaatcatccacaaattcatagagttttctttttacaaaaagaggatcagattttacacaccacaatttgctagtctccactttcataatctcgacattttttcactgttagtacatctagatcttatctgctttgttactaatagtagttcatgttgcttatatgttacaatcttaatctttcctatgttgatcactgagtacaggcattggcaaactttttctgtaaagggccagatagtaaatatttatagctttgcaggccatgcaatctccatttcaactactcagttctgtcatcataacatgaaagcagccctagacaatatgtaagcaaagtgggtgtgtctgtgttccaataaaactttatttacaaaatcaggaagtgcaccagatttggccttcaggctataacttgccaacccctgacctttttgtcttccacatttttcttcatacttttgtgttcctaaacagatgtattcaggtttggtgtttagtttggtttaggttttttgtgggagcaggtggcaggaagaatcactgattgttttttaaaaataatacattacacctgcttagcatctgattttttgcccatcagtgatattcatggaattgcttccaaagcaatgggtataacccctacttattgtttttaacagctgcataaaattccatcgaatggatagaggatctgtattggttaaggtaatgtcagctgctgtaacaaataaaccctatattctcagggcttaacacagtcacaatggatctctcacctaaggaccagtaacagtgttcctggtagatgggtgtcctccatgtggtcaaccaagggcccaggtcctttccattgcataggtctttctccctatagtgtctcagaggcaagtccaatcagcaggtagatgagaaaagagagggaagggtctggtatccaaggtcttaatggccagccctacacattgcacacatctcttctgctcatggtccattagccggaactcagtcactggctggacctaactgcaaggagactgagaaatgcagcgtagatctgtgttcaggaggaagaatatctggatttggtgggcacataagcatccctgcctgtattagtctgttctcacgctgctaataaagacatgcctgagactggataacttataaagaaaaagaggtttagtggactcacaggcctcagaatcatgaaaggcaaaaggcatgtcttacatggcagcaggcaaaagagagcatgtgcagggaaactctgctttataaaaccatcagatcttgtgagacttattcactatcacaagaacagcatgggaaaaacccaaccctatgatttaattacctcccactgggtccctcccatgatatggggtgggagagatttgggtggggacacagagccaaaccatatcactttctctaaaattaaatgacttacttgaggtaaagcagttacaacagggcctggtatgtaggaagcactcaataaatgcacctctgctattgcaagcttgtattttttaagtattctatgatactgtcatgtccttgggacctctggtcagctctttacccctgcgggttactgtaccccttcctccttctttactgcttctaatagcctatcaatggcaagcctatcaattatacacacttgctaaaatttcactctaaaaactagtcaataccaggctgaataagatatcaggaagatgtcaggttcttatcactggaaactgtacatgtcaccttatgtggcaaaaatactttgcagatgggattcagttaaggatcttgagatgggggattatcttggattatccaggttggccccaaatgagatcacagttgttcttataggagagaggcagaaggagatttcacacacacacacacacacacacacacacacacacacacacacacacacgaagacaatgtgaagacaggacagagatttgaagatgttggccttgaagcttggagtgatgcagccacaaatcaaggtttgctggtggacaccagaggctgaaatggattctcacctggagcctctggatggaatatggccctgtagacacctggattgtggcccagcaatactgagtttggacttctgtccttcagaactgcaagaggataaatttctgttgtaagccaccaagtttgtgcttctttcttacagcagccacaagaaatgcatccactgagggttctagggctctcttgtgaataaaatgtataagcttctcaacttgcaatttgtcccaaactacattccctgctctccctaccaactgccttcccagtggtcatgagctctaccatccactcagagttcactctgaaagcctggaagacttgctggcctcttcccaatccctcccctgctgtatcaaagttgatcgctaagacttatcaccatggctccgaaatagctcttgatccactggaacactttattctcaccatcacaccctcgcttgcagtgatggcattttttgcttaagctagaactcgagtctggtaaatgggttcagctgcgcctgtgtctccctctctgcctcctgccacgctgctgcctggggacagttttccaaagttgttcctgtgcccagcattccccacaggctctcctgctcctttgagagagaatctaaactttaaccaaaccttgaaaatgccctcatttctcgccaactgagccatgatggggatgacttaggcagggagacaaaatgagcctggttgcaataaagtttggtgattttttaaatgaatctgagctcacgtgtaattatgaaaaaaaaacatgaacatgttatatagtttttcactgatggctggtatgaagatagtagcattatggaaatgagagacaacttgtccatgaggaaccctcatttttttaaactgttaagttcaggggtacgtgtgcaggttcgttctataggcaaacttgcgtcatggaggtttgtagtacagattatttcgttacccataaagtacccgttagttatttttcctgagcctctcccacctcccaccaccaccctccaataggctccagtgtctgctgtccccctctgtgtgtccatgtattctcatcacttagctcgcacctattaagtgagaacatgcagtacttggttttctgttcccgtgatagtttgctaagggtaatggcctcaagctccatccatgtccctgcaaaggacgtgatctcgttctttattatggttgcatagtattccatggtggatacgtaccacattttctttatccagtatatcattgatgggcatttaggttgattctgtgtctttgctatggtgaatagtgttgcagtgaacatacacgtgtatgtgcctttataataggatgatttccattcctttgggtatatacccagtaatgggattgtgagtcaaatgttatttctgtctttaggactttgaggaatcgccacactgtctgaggaaccttcatttgttggaaaccacccaacacagagtagatgctcaggaaataaatatgcagtggatgagtaatatgtgcagaatgacctgactgagtcacaaagacctttctggttgcatttgcatctgtcattgtgtacatagagcccttccccttagttcagagtctctccccttggcactgtggagatttgggactggaccattcctttgttgggggtgggggctgatgctgtgcattgtagcattagtttagcagtatccctggcctctaccctctggaattgtgacaatcaaaaaggtttccagacattgccaagtgttctctgtggcaggggtgtggagtgaagggcagaatctcctctgttactgctttagctgatcgcagtgaggccctgtccctttgcagaactttattccattcccgcctcccacggcatcctcctcagcttcctcctgcatcactctgccgttggcatccccccaacacatacgcacacaaacgtgcacacatgcacgcacacgcacgcacacgcacgcacgtactttccttcaattgctccccatctggcttatgaaactgacagagaataaagcttctctcttaccctctcccaacccccacgtcgttgtcctgcacctggctggccatccagggctcatctcttttctctgaaattctccaagcatccctgtcattgtcctgcacctggccggccagccagggctcatcttttctctctgaaactctccaagtagccactgaagtcagcaggaactcccaaagcagagacatgccgtggggggaatatgggaatctgtcgcctgatttttcatggccttctgaaatcacgagaaggggttgcatggaaacggttgaaagaaaatgattttttaagtgcccctctggccacactggccagattcaggctaggtctggcagccagagctcagggcaccacgtcatgcctgaattttgttttatttttctatccattattcgaaggaatcatgctgactttggctattaagtgagcacttactatgcaccaacaaagcactcggcatgtattcactcatttcacgccactgcaacctaggagatggacacggacactattattatccccattttacagtggaggaaatgaaggcttagagagacactttacccacgggacacatctagtaggaggagcagccaggatttgatctcaggactgtctgatgccagatagtaataataaaaacagctaagtttactgatgtatttactgagtgccgggtgctgcctggggggctttacatgaattgatttacttaatcatcccagcagcgctatggactagaaacctttgtgattcccattggtggatgaggaaaccgaggcacagcaaggttctatgacttgcccaaggtcgtgtggctgggctcccgtcgtccagctcttaaaccctctgctctagtgcaggggaggaggcaaaccatgtctcataggccaaatccaatccactgcctatttttgtaaataaagtcttattagaacacagtcatcccattcatttatatgcagctgctttcacagttcaatcgcaaagttcggtagttcagcagagacagcgtgacccacaaagcctgaaatcttcaccgtctggccgtttacagtaaatcttttcaacccctgccctaggaccttccctaactaccatcctgccatccaagctgtggggccccttccctgctggagcagcagcacatcaaagaacgtaaacgagtgggcatttctgcagcccccagaaagcaagccggcatcccaggaggtgcctgggaggctctctgagaaggctgactccccacctccaccatgtttcctggaggtttggctgataattaggccagtcctattatcaaaaagaccaaaataaggccgagcacagtggctcatgcctgtaatcccagcactctgggaggccgaggcaggcgggtcacctgaagttaggaattcgagaccagcctgcccaacacagtgaaaccccgtctctactaaaaatacaaaaattagccgggcgtggtggtgcgtgccagctatttgggagactgaggtaggagaatcacttaaacccaggagacggaggttacagtgagccaagatcatgccactgcactccagcctgggcaacagagcgagactctgtctcaaataaataaataaataaatttattttaaaaaatagaaataaaataacaaatgctggcaaggatgctgagaaaggggaactcttacaccctgttggtgggaatgtaaattagcactattgtggaaaacaatgtggaggtttctcaagaaaactaaaaatatagctaccatatgatccagcgatcccactactgggtattatccaaaggaaaggaaatcaatgttgaggacatatctgcactctcatgttcattgcaacgctattcacaatagcccagatatggaatcaacctaagtgtccatcagcaatgaatggaaaaagaaaatgtggtaggtacatatacacaatggagtactattcagccataaaaaggaacaaatcctgccattctcagcaacatgaatgagcttgagggacattgtgttaagtaaaataagcgaggagcagaaagataaataccacatgttctcactcatagttggaagctaaaaaagttaatctcatggaagcagaaagcagactggtggttactagaggctgagaatggtgcaggggtgaaccagaggctgcttaacagatatgaaattacagcaagagaggaggaataagttccagtgatctataccataataggatgactacaactaacaacaattgactatgtattttcaaatagctagaaaagcagattttctttctttctttcttttctttttctttttaagacaggatctcactgtttgtccagtctggagtgcagtagcacgatcaaggctcaccacagcctcaacctcctgggcttaagtgatcctcccacctcagcctcctgagtagctgggactataggcacatgccaccacacctggctaattttttatttttgtagagatggggtcttgctatgttgcccaggctggtcttgaactcttggtctcaagcgatcctcctttctctgcctcccaaagttttggaattacaggcatgagcgaccgtgcccagtcagagcagattttgaatgtccccaacataaagaaatgataaatgtttgaggtgataggtatgctaattaccccaatacattgtatacctgtatcaaaatatcacactgtaccctataaatatatacaattattatgtgtcaattaaaagttttttttttaaagattgggccattccacataggcccaggtgcctgcctcagccctggagaaagagaggggcataaagaaatctaagttgctttctcctcagtctacttaatccctgacaaaacctggtacatcttccacagtgagatcatatgtcgcctcttccatgaagccttccctgattccttcaggcagagtgggtgaggatttcctctgggctcctcattgccttgactaccttgtcgcatcctaccacgtaacagcaaagtctgattttccctttacatgcctgaagcagacactctcagggccttgcccacatccccactcttactgcttcagtgcacagctggactgtgggtttctagctgccaacacctgtgtacctttacccatgggccttctctcaccaccagagagcctgctttgcctgcctgcgtggcaagtccaaagcaccagagtgaatgcctctgttccctggcaccagccttcagccagtgcctcacaggagtgggtgtataaataccactgctccctcgctctacccctccaccccgtgggatgacggcaagtggcgttttctacactgactcgcacagtgcctcagcaggactaagccccagttgcccatggtggtaacttgcttgatgacacaccctgtatcggctccttctgtttctcttatcgcatccccagtcccctactggtgtttctcaggatcatctcccaaataaactgcttgccctggaatccttgtctcagtgtctgctcctagggagccctcatcaagtcagcatcctctcttatccctcctgcaggcaaaagctgggtctgtctctgaacccaccacagggcctgctgtagagcagatgctcacatcagtcagtcgtcaaaaaagaaatgtactgagtagctgctgtgtgccaggcaccgtgccaagccctggggacacagcagcagacagaaccgacaaggtccctgccctggtgagctgagattctaggacaatcaaacacaaataaatacatgagctaactttagatggtctcagtgctctggaggaaataaaacagggtcatgtgcaagacctaggggtcttccatactcactggggattgtttttaatgacaatgtccaggccttatccccagaaatgtctgattcatttggtctgaagtggagcctgagcattgatatttaacaaaaaaaacacctcccaaggtggttctgatgtgcaaagaacacctgaaggtgggccgggggtggtggtgaggacaggcagctggcctccctgaggaggtagccttcggctaagccaggcgaacaagcaggaaaagtgctctaggcagaagcagctgcacatgcgaagtcccagtggcaagaggtactatggtgcaggatgttcagcatgatgggaacacgggctgccaggaggagacagagagagatgaggcccacaggcttcgggtccttggtcttagagctcttgagccattgtggctcagactgcagatcttaacacatcagcgggttatgaaatcaatttggtgagccacagccagcatcgcaggaagaaaagtaatagaatcgaaaataccagagtgtgttgcacatgaggtcagtgtggttttttgaaacttttatttgaagttttataaaggtgtacactgcactgcattgcaaaacaggtttcttactgtgagtcttggttgaagaattcgaaagccactgtttttagtccctgtgaaagtttggaatttagcccaaggggcagtggggagcaattaaagaggttttagtggggggcatgacaaggtcagatgtatgtttaaaaatctcactccaggagtgtggagaacagatttggaggaggtgggcagtggaggctgggaggcgtcttggcaggctgttggaggcagtcactggggtgtgacaaagagaaccaagtagcacctggcacacagaggtccgcaggtggctgttgaagggatgcacgtgtctgcaacatgggaggatcctgggaggttgaaaggcaacatttcaagctttgcctccaacccctccctgggatgaccacctacttgtcacctgtcctgtgacgcaggtatcccaggcatggcagataatagactctgattttaacacttcctgtttgccagacactctgctaaatgctttcaaaactcatgtaatgccctcagaacaaccccattggtaagtactgttaggattcccgtttcacagatgaggaaactgagaccaagaaaggatgttacttgcccaaggtcacagcgatcatcaagctgtgtagctggcactccagccgggcagtgcggctctagagtctgtgtgccccagcatctgctgcagtcatgtgggagccaagctgcttgggtttgaatttaggggataatacactgagtactctcgtgaggatttagtaagggacggtcagtgagtaatacattcagggcagtaagggcctggagcttaggacgtgctagataaatgagagtgagttgtgccactagacgcccaacttgtagagttggattcaaattcacgtaacttgtgaacagacggtggaactgccagggttcgaatccgcctctgacacttaactgcctgcatcgcaggagtgtggtaccagcgctggctcttgtaattaggtgctctatgtccagtacttagaactgagcccgaccttggtgaaccctaagcatgagccattgatcccactgctcaaggtcatacaggaatacaagggccaaggctggagttcaaacccacagccagcttgctactgagcaactacagcccagtgtaaaaagggctttaaacagtcaagttaggtttttctctggctcttcgaatccttaatcccttctctccatgtctgcccaccagcagtgttcccaagttagagcttccagcccaggcaggccgccagagtcaccaggcaccccagggcacagagacccatccacagccttgggcaaaggtggggggttggagggaagcctctgagagagctggaaggtcccagccccgcagtggccaccaggtgccagggcctgggcctcacgcctcatagctcctgagtctgacctaagcgtgccttcttcccagcgtgcagaactgtttgcctgggcgtaggttggagacaggtgaccccacctggttggttcaggcccacgcttgttcagcctcctagacgctctgagtcttggcctcctgactcctctggggttggcgcagccttgcttgccttggctcccgtccgccgggctgttccctgcacgtacgagtggccctttagaatgtgtttgtctggtcaaggttgacaaacttcctgagcccacgtctgttgacttttgtgggaccttctggctacctggctgtcgcggatgcttcgctcaagccctgtcttctctcttggggtgtggagtcagctaagagggcagcagagctggctgtgttcacggaatccagtgtctggagagaaagctggtgcccatggcggctgggactggcaagtgaaaacttgaaattccatgaatgtagcacctggtgattctttggagaactttaaaatgcagcatgagtataaactgttcttaacaaccaggatatgaacgaggcaacctcttacagtctttttttctttttcttttttgggatgggatatccctctgttactcaggctggagtgcagtggtggcatcatagccttgagctcctgggttcacgtgatcctgccgcctccgcatcccaaagtgctgggattacagggatgagccactgtgcccagcataccgttcattcatttgttaattcagcaaaatactattcatcacatattctgtggcaggtgctgttctaagcacagggatagagcaggaacaatctagctacagcctctgttctcatggagcatgttaaggtctccagcaacactgtccgagaaaaatataacatgctttaccagtgtgagccacatatgtaactgcaaattttctagtagccttgttaaaaaaaatatgtaaaacagcaggcctggcgcggtggctcacacctgtaatcccagtactttgggaggccgaggtgggcggatcacgaggtcaggacatcgagaccgtcctggctaacacggtgaaaccctgtctctactcaaaatacaaaaaaaattagccgggcatggtggtgggtgcctgtagtcccagctacttaggaggctgaggcaggagaatggtgtcaacctgggaggcggaccttgcagtgagtcggtatcatattgtgccactgcactccagcctgggcgacagagcgagactccatctcaaaaaaaaaaactgtgaaacagtacattttatttaactcaagatgtcaaaaaatattatcatttcaatacatcatccatacttttaagattactaatgcattattttactttttttgtatcaagtctttgagatctggtgtgtgtttggacacatctcaatttgttttttgtttgtttgtgtttgtttttgttttggggacagagtcttactctgtcacccatgctggagtgcagtgacgaaatctcagctcactgcaacgtccacctcccaaggttcaagtgattctcgtgcctcagacacccaagtagctgggactacaggcacacaccaccacatccagctaatttttgttttgttttgtttttagttgagatggggtttcaccatgttggtcaggctggtctcgaactgctgacctcaagtgatccgcccacctcggcctcccgaagtgttgggattacaagctggagccactgcacctggcccacatctcaatttaaactagccacatttcaagtcacctgtggctcatggctactgattagagtctaaagagagagataagcattatacaattaaatactcagctgttaattccaatggtagtaaatgtcatgattgacaagttcagagtgcagtggaaattaatccagtcagggaggatggtgatagcagtaatggtatcagggaaggcttcctggaagcagtgactttgtgatttttatgcagaaacctaaagtggggtgaaggggaaggatgagcattcaggacagagggaacagctgtgagcagaccccaaggtgccaaggagcttgctgcttttaagggataccaggtaaaatgctggtatcaccagagagttgagtaggaagggatgcaacaggagaggttagcaggagccaggccatgtgaagcagctcacatggctcctggtgcacagcagtgctgcactcacaatgacaattggcacttggagagacagctgctgcttgcagttacatcacagatcgggatgattggcttgaccttgtgtattggaggcctccaggacaacccctggtggtggcatagacagcagccatcatccctccttgcaggccaacagaagctcgatcttatctggctgaccatgggctctgcccaaggagatgaagggtggttagaccaagccccttgtgattggtctggatgagatatgggggatggctgctggaggatgctgatggagatattcctctgagataaaatgaaggcgccacatgaatggagcctcttttcccactttcttccttcctgcttagagtagggccatgtccagttgtgtttcttagaaatgtggcttctgatgtcctgtgaccctagggggaggacaagagacaggcgaaggtgcccatctagggccctgatcttgttaacccacctgaaccgccatcaccagacatcttagcaattgtgatcattcatatctgcaccttttactgtaacatgcattgtgtgggatgaacccaagaatggcaaacatttacctggcacttactgtgctccaggtgttcctcaaagccctttgtctcacgtcatcctcacagcaactctctgaggttggcgcctttcttatccccattgtacagatgagcagggactcacgcccaagggttgcggctgtatcttttaaccgtcaccctatactgccccctccgtgtttaaacatgttggtttggaaagctcattcccctccccttcaccaccccccagaacatcattcctctaaaacaggtttctcatgctcagcacttttgacattttgggttggatgattgttgtggagctgtcctgtgtgttacgggattttagtagcattcctgacttctacccaccggatgccaatagcaccctccccattggtgataaccaaaaatatatccagacattgccaggtgtcctctgggcagcaaaatcccaccccgccgcgccccccaccgaccccactaagaacctctacgctaaaagatgttttcctgccagtcacctgggtcgctctgtgtccttgttcaggttaacgtttctgaacctctctttcctcttctgtaaaatgaggggacagtattacgtatctcatgggttattttaaggattaaatcaaccagtgtatggaaagcagctaacagtgctgagtgcataatgagcacttgctcggtgtgatgatttgacctacacggctctttcttgtctgttttcagctaacaggaactgctagctgggattttttttaccagcaaaagagaattccttgatccaaggtgaaatctaccagggtgttagctctgggagtcagaggctccatctgtcttcctccgctactggattgccaggaatttttttttgttttttgtgttttgtttttggttttttttttgtttgtttgtttttttgacacttagtcacccagactggagtgcagtgatgcaatcttggctcactgcaacctccgcctcctgggctcaagccatcctcctgcctcagcctcccaaagtgctgggattacaggcatgagccaccgtgcccggccgattgccaggaattaaatcagtgctggcacatagtaggttctctgtagtatttgttgactgaataagtgacttaaatccctttgattagctatataacttttttatagatttctcttgtttctttcattcttccctgccttcctctgtctttgtttctcctcttttgtttttgtttgtttacttatgtgtcttgttgttgttgttttttatttgtttttactatggctttggtttcactacccaagaaatcccagacttcagcactggaagctaaagctgaactaagctaactcaggagcctcaaatctattttaggagttaattcccttggcttggttcagccccacaatgcactctttgggggttcatttaatttttcttagcaggttctggctggatgttaaacctgggcaagggaatgtgcttcaggctgttgagtttaggctttacttagaatctgaagtccctccaccatttgtgtacaaacatcattataatataatttactattaaatgtaagggggtgaaggggcatgcagaggtcacacatgttccctgaaacataatcctataattaaaagtgtgctagaccataaaacttacgatgttcccatctctaaggctacttttataaaatgcatctcatgttcttccgtcggatcttctgacctgaggcataatattaaaacatagatcaactcaaagggtctttgatttatatggtacatttgcagacaccgactgcagttcttggtgaagaatcagttctcagattgccatagttaagcgcgactgaagcgcggtgaaagtacttcctaaaatccagagcgaatgtgaattcatctttttctcaaatagccaccattttgaaaatttctctgtttccatttcactactgtcctctgctatagaaattagggttttctgcttgtttaagtgtatataaaaatagaggagaggttctcaaccagggttgatgttgaccccaggggacattttgcaatgtttggagacatttttagttgttacaactcggggagagggcagctactggtaactggtgaggacaggggccagagatgctgctaaacagcctgcaattccctgtacaacaaagaatcacccagcccaaaaacctcaatagtgccaaggctgagaatttctgagatagagagacgttcgtttcatcattgattaaaatagggtaaaaaaacccaaactgtgaataacctggatgtacattggtggggggatggttaaataataaactctgctacattatttcagtggaatactatgcagacattgaagaagaagcaggcggctccatgtgtactgatgtcgaaaactgtccaggatgtatttttaaatggaaataaaaacaaacacaacagagtttttgttaaaccattatgtttttggtgatattaaggaattttgtgccttaatgttaaggaatattgtggctatgttttcaaaaaaagggtctttttttagagagagacttacacggaaatattgacaaatgaaatgatattatggggtttgcttcaaaatactatgacgggggaaatagatggagtggaaatggggcaggactggccatgagtgctggggctgtgtgatgagtttaggaaagctcattagatgagtctgagtatttttgcagtgtttttgaaattctccataaagttgctacacacacacacacacacacacacacatgcacacacacgtaaatgcactgaagaagatctggtgggagataagagatggtgagtagatagaaaaatacagacagatgtagatttggctctgtgtaacaaagagcttaaataacagtggcataaataacctaggagtttatttctctctcatctaagagtctgagcagcagctctgctctgcaaagtcatcagcagcccagattcctttcaacttgtttcctcatccttaaggtgctgctcttttcctcattgtccaagatggcactccatcacatgacgttctatccaataggaatgggaaaaagaggaaggtccaccccattcctttaaggacctaacctacatgttacttgcatcacttttgattccaccctagtgactgcgcttagtcacatgaccacagcctaactgcaagggaacctgggaaatgtagtctttattctgggtagctgagtgccctgctaagaatcagttgtttgtagaagagagaagagaaagaatattggggatcacctaacaatctctaccacggtgtactcaaactgtgaatgataattagcacagatcagtgggactatggggaacttatcttttcacattatatgttgctctgactgttttaccattagcatgtgtattttctcttttgtaaagagaattaaatataaaaaatgttctgataagtggtgcatgcatgatccttgtatgtaacactgtgaggctgtagtgtcatttttcaatattcatttcgctggtactcattgcctgactgtttagtgctgattacaattactttattagatgctaaggacacaggagtgacaagacagacaaagcccccagcctctgacagtgaacagagaaatatgcagtatattttaagatagtgatcagaattaagaaggcaaataaaacacaatcatgggataggaagcagggggtgattagggggatgtaggaagagtttaacaatatgatcaagaaaggaatctctgaggaggtgacgtttgagaaaacaccacaggtggaagaggatttgttgcagaaggaacagcaagtgcaaaacctataaagtgggaaccaacacactaggtttaaataacagcaaaaaggataatgtccctgcaggagaagctataagaacagaacttccagaaggtgcgattagagggtgggaagggttttggattaagtgttatattaggtcatttgggtattaattactccaagtcattatgaccaaaaggtagttttcctaattatttgcaatcattttcaaaataattaggaaacatggaatgtggaaaaacactccattggcacagtgtcatgtggtgaaatgagatctgcaccttgttccggctctgcctgtcattagctgtgggacctgaggaaacttacttgatttcttggcctcccagtttcttcacttttaaggatggagaagagcacttactctgtatcctattctgctctcagaactacacaagtagtaagtcattttatccccacagcagccccaggaggtggggaccctttttatccccacctggcaagtgagaaagttgaagcagagaagtcaaggaagatcccacaccattagcaagtggcagagccaggatttgaactcaggcacctgggcacctgaggtagctgcttagtcaccactgtaccaggttcctgccggctctgcctacctcacagtctggttgggagtgtgcaatgaggaaagaattttgacagcaactttcaagaatgtcaatgctgaacaaatgtattaacattattggaatattctggaatatctctcttctttccaaataaatattttaaagtttctaaactcctaatgaaagaattgattcaggccacaaacattagtggatgaaaccatcagatcggaggttaatggggaactttataatggaggaagcaggtggtgctacctgaacacaagggccctcgtggtgtcactaggagggacacacctgggactcctgatgagatgcaatggtgagagcccagcacaaattccagagcattgctgccctcccccaaattactctgaacctaatcacatttcaagctaatttatgggaaatacaatgaaaagagaaatgcattaacaacaccgtgaacaggcagacagacaaatacagaacgtgagatattctacaacacaactaacctagtttctccaacacatcaagagtctgtataaaaaggagggggaggctattctagattaaataaatgtaggcgatacaataagcaaatctactgtgcagacttcgtttagattccgtatcttacaatccacccttacaaaggcatgttgagacaattggggaagattgaatgtggactgtgttcacgatgacacaaggagtgagtgtgaattttgttagatgtgataatagaaaatctccatagttttaaatgaggtgtggtggagagaagagacttcaagtttgaatttgttttaaacacttcagcaaagagaaaagtaaacaaaccaaaattctgagaagagacacatttggaaaaaccgtgaacattgttgagtctaagtaatgggtgcacagaagttcattccactattctgtctgcttttgtatatgttggaaatttttcattaaaaaaacttctagccccactatgaagccgtctgaccaaaagagaaggaggaaaaaaaaaaaaccctcatcgtatgaaattgcataaaattcagccaacctcaaaacaagaataaaaacatttttaaaaaaactcatgaatcgctgcatggctctttcaatttcggggtaatgatgtaattagaggagctcagtcattagaaaagattaattttaagacatctgctgctgtcagtggcagatggcagaagagtggaacattgaaagcacggggctctcaatccatctctgctacttaccgttgattttaggcaaatgtcttcaatttctgtcctcactttccttatcagtaaaatgggattaaagttctataggggctattgggaagattaaggggactcaaatatgaaaggcacttaaaacaatgtctggctcatagacagtgcttagtctacgtgaactactattattttcactttcatggtggtcagagcttcatgggggcacaaataatttggaccaagtgaagatattctcatatttggtttccaatattcagtttctcttacccattttccaacatttctctcctgcctgtttctcttcccccagtaaaaatgcccttgctctgtagactcagaacaaagctcaccacagttttagtggtctcacttgggtccaggtcattgcaatgggctatggttgggatgaaggaaaggaagaggtaaacagtgaagggtaatgttgctggtgtggtatctgaaagcaaaatgcctctgcaacctgaggattctctttcctccctggatctcttgcctgcctcttggtaggataccaggactccaggattccaggactcccccagtggcctcaagcacttcgtgttgtccagccatccttggcaggaaggactcttcccttacaggaagagtccttggtgttttgctttgtgccttgttttggtggttgtgggttggggtgtgggtttggtttggcttttctttttttctttttaatggctctgcatgagacatattttataaagttctacattttgctccagggccctgctgaacccaaccaggaatcaagcagaacatgtgtggtcctgtccgagtctgtcactgcacgttgggtgcctttttgaaggttgccttttgtgggcctagagaatattggaacacgcatcgtaaaatgcagacatctgaacttgcatcatgtgtttttctaaaaagctgatctcaagaggttgcatactgcgtgattccatttatataacattttcaaaatgacattttagagatggagaacaggttagtggttgccaggagttaagggttttgggtcgggtgggtctggggtgggtgtgcctatgaaggagcagcacagggagatctttgtggtgatggaatcgttctctagattgccgtggtggttacgcagagctgcatgtgtgataaaatgacacagagctacacacacactgcaccaacctcagtttcctggctttgacattgtactatggttatgtaagatgtaatcacagggtggaagacattgggtgaagggtactcaggacctttctgtactatgttttgcaactttttgtgaatctaaaactatctcaaaataaaaagttttggccgggcacagtggcttatgcctataatcccagcactttgggaggccaaagcaggaggattgctggagcccaggagttcaggaccagcctgggcaacacagtgaaatccagtctcttaaaaaataaaatacataaaatcaaataaaatgaaaaaagtttttaaaaataccagggacagcaaaattgggttgattgaccaaatgatgggcccttgttttacatgcgatcaagaatgagggaaacaggctgggcaaggtggctcatgcctgtaatcctagcactttgggaggctgaggcgggtggatcacctgaggtcaggtgttcgagactagcctggccaacatggcaaaaccccatctctactgaaaatacaaaaattagccgggcgtggttctgtgcacctgtaatcccagctactcgggaggctgagtcaggagaatcacttgaacccaggaggaagtagagtaaaagctttcccaccagctgtttttattttttattgtatgccaagctcatatgaatgagaattcatcaagcatagttgagagaatttagtctggaattgagattcaagactcaagctggtttccttttgtcataggactccctaggactcagtccgcttggctgaaggatggtgctctgaataggctgctggggaggcatattgcttatgcaattgcttatgtaagctgagtgcggcggctcatgcctgtaatccctgcacctcgggaggccgaagtaggaggatcacttgaacccaggagttggagaccagcctgggcaacaaagtgagatgcctgtctccacaaaaaaataaaaatgaaaacactaggcaggtgtgatggtgcacacctgtagccctagctactcaggaggccgaggtgggaggattgcttgagcccaggaggtggacaccaggattttgctaggcaacacaacaaggccctgtatctataaaaatagaataactgtttatgtcttcctaagagagtttttgggttttgttttgtttgaaatggagtctcactctgtcacccaggctagagtgcagtggtgcgatctaggctcactgcaaactccgcctcccgggttcacgccattctcctgcctcagcctcccgagtagctgggactacaggtgcccgccaccacgcctggctaattttttatatttttagtagagacggggtttcaccgtgttagccaggatggtctcgatctcatgacctcgtgatccacccaccgtggcctcccaaagtgttgggattacaggcgtgagccaccatgcccggaccctaagagagtttttggataaagctttccaatcagggagtaaaaacagcacaagggatgaagacatgggacattccgtggggaatatagattggactcaccgctctgaggagcgacatgcaaacgggtttttcagttttaaactggggggcccagcagtttttccttggggtatcacttctagagaactccaggcacgtgcacccaagaagacctgctccagtcatgtggaattcgttctcataacaacaacatggaacccctgaggactggacaggtgaactgtggaatagacatacctgcagataccatgcagcagtgagaaagaataaactagatttctgtgtcatggcatggaatgaacaccaaggtattttattattagagtgaaaaaacatcctggaacaagatgtacaagatcaatagcgataacaacacattcacaaaacacatttgtaaaaacagtactgtatattttaatgaaggtgtgtgggtgtttgtgtttataagctatttatcctattaattgtggatacatctggtaggaggtagtgccccaatgtggctgtaatcttatctgaaattttaaaatgtatttacaaatatttttagatgttatttgggtaaccaaaattctattttaaaagaaaaagggccatgcagttcttatctcagcaggaggaggcacaggtggactagttggggtcacctgttgaggaattcctactaagtctggatagcaaatcccactctgaaatgccaacttcaggagagcaggaacttgtctgtctggttggacactgtatcctcaatgtctgagacagtccctggttctttgaaggcccttaaaggacaggggaaggggaggaaagatgaaatcaattagtgaaggagtagcagctttgctctttggtgtgctatgtaaacagcatcggtgattctaaatgatgggcagcctgactcaatgaatgaatcagtgaatggctttagtgtcagctgtgttcctgatccatttatctgccttctagcctttgcaaaggaaactgaatttgccttatttatctggggagatgattcccaacacattgcagccctgccccacaacttctattcaatgacacttccccatgttaagggagacagggtaggggaggatggaggtgtggacaggaggagggatttgtgatcacttccttgtggcttgtggagttcttccccaaagttgttgaagtgacaacagcacctgaatttcactggctggacccacagctgattcctactctaatttttcacactgaacacctggggcgtgatatacctgtatcaaaacaaaaggcagtctgcagtcccgcaggcaagggtctgcccacggctccaggtaggcatcttccagggcttgtgtgcagcaggagagaacgtctcttctccagcagttcatcttgggcctcccgttggccccaggtggctcacgtgaccaccaccctggagccaatcactgtagaccgaggaatgggagatgctaattgccaggctcagagcttgttagtagggtcagtcccagccaagccacgtggactgagagtcatggggagacctagggaaattaaataactcacaaacacctgtaaaaactgttacagtgactggtgtgtgtgatagagggccatgggcctgtgaaagctgcaggagggaaatcgcttactcagggagagcctggggaaatcctgccggaactgaggcctctgcagggtgagcaggagggactggagttccaggcagagggaacagcatgtacaaaggccctgtggcaagagggagtgtggagcgagagaaaggccagcgtgctggaatcagatattggacaaggagaagccagatcaaggctgtgttcggaactctttgctttatcttaagagcaatggaaagccgtcagaggttataagcaaggatgaggtgaggcgggcaggttcagatttatgctgtcatttgctgcacagagaacaaactggagggaggccccggtggccccagggaggtgggcaggggggctgccgtggtcttcctgggcagagaggatggtggcttggacctgggcgatggccatggaggtgaactttataaggcctggagatggattggacgtgagcattgaaggagagggagaagtaagagcaatcctgagcttttggtttgagcaactgcccccgaaatgggggaagccaagatggtttgtgattcacagatgtattttgaatggaaattgaatgaggctggtggaggctgtcagagacgtccaggtttgggccacagctgctgtctgtccagaagcctgtgattgaagtcagcaggctttgatttctcagcccgtgaaggatgctgggagtgaccctctccaaagtccccttagccgactggccatctgtcctctgcatctgacagacagggccaccatcctcagccaaggtagctggtgtactcacgggggtgtggaaaggtgagcggcccacccgcctgggaccctccatctgcttttgatccctcccagcctttgaagctgcccctgcccccaccctccagctgtcatctctcgggctcccccacttcttcccagtccccagggacaggggtggtgacaagggtaacaaatggcacaagccgcaggcagcagcaggccaagggggccagagggagggtgttcctgaatgcctctttcttcccgctccttcaggctgtcttctgaagtagccaggctatcagggttttgcaacaatgcaacaaagaaagaattttttttttttgtaaatgaattccatgcttttccttcctttcccttccctgccttcgtgaaagggaagctaagtctttctcctaccccagattccttgaaggctgtctgagttctctcttccttcccctgcatagagaataagctggtctccaatttcaggtaattgtgaggtggggaagagtggggagaatgtgaaggaagccttccccaccaaagtgcagcagagctcaactctgcccctcaaaccacaataggaaccagtggtttccgggtgatcctgatgacagtttccagtgtctacctggaatgaaacgaatggtgtgtttcaagcctttgtctgtgtgcatgcaaataatctcagctgccctttgttgaatacccactcactcgtgccttctctgactcatttttctcagaataacctggcggggagggtattattttctccatcttatagaactgaggctcagataagtgaaataacttgcccaaggttacaccgctgataacgacatagctgggatttgaacccctggagcagataacacgtctggtgctctgactgggtagcttagtagactttagagctggatgggccctgagttgaaattgtgatccagagctatttgcaagctgtggttaagagcacagatctggagccagatcacctggttgagaatcctgactctaccactgactagccaggtcagtctctgaacctgtctccttatctctacctacttcataggatgaaacgagccagtgcatgcagagagatttaagcctcagcgtaaatgctctgtaactgtgagctgtttttatttctagtatctgtaaactaagcaatataattagggccaggttaagacctttagcagcctcaaacaccagagactggcctctctcctccattgtctcctccaatacaataataaaacggtgtggttcgtaagacaaaaaactcgctgtgctgaaattttttttacaattttgtttagttttgttttttattgatacataatagatggacatattttcagggtgcatgtgactgtttgatacgttcatataatgtatacagatcaaatcagcataattgggatttcatccccttagatatgtatcttttctttatgttagcatcattcaaattactctatactctggctattttgaatgtgtgataaactattgttaattatagtcaccgtactgttctattgaacactagctcttattccttctaactgtatatttgtacccattaatcaacctctcttcatcctccccaccacccttcctggccttcagtaatcacagtctactctctatcttcatgagatctacttttttagctcccacatgtgattgagaacatgccatatttgtctttctgtccttggcttgtttcacttaacataacgacctccagttccatccatgttgctgcaaatgacaggatttcattgttttttatggctgaataatattctagtgtatatgcataccacattttctttatccatccatcaattggtggagtgcgctgacatttgaaaagcttctttttagatcctcatggcagaacaggataagttcaccaaacaggaatgatttcacgttttcttggtgtctagactttgctcagacttaaatctgtgtttagtcggcctttgaggaaatacaggacagatccttctatctcccagcgtggttgagagaattaaaagagatcatgtaaatgtgatcaggaaaattgcctggtgtataataggtgcttgggaaatgagaaccatgactagaatttttggaagggttttactaactctggaaactgagttgccttgagttgcttgttcacattcctatactctgtggctaatagtttgcttctgcaagtcaccagtgcctgtagctgtagctgacagcaggaaagaacaattgtcaggttctcaagtcagggtcatgtttactttgtgaagattaatatttctgtagctttggctttattagtgctgttcatttatttgcctccaaaggatggtgtgttttgattgctataggtattttaattgctataggtattttagattttgcagatctaattctaggtctaacagagccctagaatcagtcaagtccctttcttcatgcacattaattttggaaaaaataaacttttaaattatcatatattggtggattattttatcattattgtatgtccctgtaaatctctaataatggtttttattttaaaatctatttggggtattgtgttgtattcatattattgaatccttgctttgaatcttggtatgtctttatatttaaaaggggtctcttgtaataagcatgtagttaggtttttaaagtcagtctggtgatctttgtctttcaagtgttgtatttattctgtttgcatttactgtaactaatgtaatataaacatacatgaaatgtttacatttattattattctttaagtggttatcctaaatattataggatacattcttgatatatctaaaagtttactataaattagtacttttaccatttccaagaaaatgcaaggtccttaaaacatgttaattgtatttatctatcctcctgctcacatatttacccttttatgttgttctttatctttgctgaattttcgtgtttccagaatattcttttttagtgcaggtttactgatgggaaacaatcttaattttggtttgtttcattttgattttgtcttcattttgaagtatttttttgctggcatagaattccacagtggcagatgaaattccattgttttgtggtttccatcaattctgctgagaagctgcttctcagtcttattataccttctttaaagattgtcttttattccccctctgactgcttttaagattaatttgtgcacatgtgcagtttaaccatcacatacccaggaatgcttttctctgtatttatctttgggattcacagaacttcttgattccatgacttgatatctgtcatccatctggcaaggtcttctgtcagtttctctttaaatattgtttctgacttgctctctctctcctctccttctgtggctcctattacatgtgtgctagatcttttaccatgtaccatgtttcttttatgctcttttaaacctgtttttcaaccttattcctgagatctgtttactgacttaccttccagtttgctaattctttcatctgctacatccagtctgtagttcaactgatctattgagttcttaattttaattatttcatttctcagttctgtaatttcctttttttttttttttgagatagagttttgcttgtgtcacccaggctggagtgcaatggtgcaatctcggctcactgcaacctccgcctcctgggttcaagcaattctcctgcctcagcctgccaagtagctgagattacaggcacctgccaccacacctggctaatttttgtatttttagtagaggtggggtttcaccatgttggccaggctggtctcaaactcctgcttcaggtgatccacctgccttggactcccaaagtgctgggattacagatgtgagccaccacacctgaccagtaatttccatttttaaagagcctagatttttttagcagcattctcatcttaaatcaatttttttattatattatcacagttgctagggactccgtgtttgacaacttcaatagcagaatctcgtgaggtttttgtttttgttttttgtcttggtttttgatcatttggttttgtctttttgcatgcctggtaatttttttattgtgtataaaacattgtggagactctggaagatgacatctcctccaaaagaaaagtttttctgctggctattgatgatagtagaggcaaatcactttggtcaaatatgagattgagatgactcaaggcaggatctattttgtttgctgttactccaaggaagtaatcctttagggtcccagttaaaagttttgagtgtttctcaaggctcctcatccttattggccatgaattccaatttttgccttcctgtaattaggcaactgcaaaaaagctctgcttaatttcttgcctttatagctaccccctttttgcttggtttctctgcctctcaccgcacccagcttggatatcagcaaatgcctcaaggctaataactttcaacaatatgagactcatacctctgtggttctcatatttctacaatctttgctcctgtgtcctaactactttagtaatcctgaactccagtttttttctccccagccccataagactggaaaactctaagctgttgctttttttcttctttgcttataaactggcaagtgtcttgaggggaaaattgatagaggtcaaacttggtctgtttttcatctctctgggatcttgttccctcaggacctgccttggttgacttccaatcccttaagacaatattttatagctgttatttttgatcatgatagtgaggttgactaaaaatacaagctatcccgtcgtagctgggaggtgcactcagttggacagtttaatacatattaggaaaaatggcttatttttgttttcttcaatatggagaaaaattaaactttaaaccacataaaaaggcagactctaaatgaattgaagacttaaatatgaaaggtaaaattctaagtgaatagtttaacatgtagacaaattttaaaatcccaagaatagagaaaggatttttacacctacaaaaagaaattattaggtaaatatgtaaggattttttgttctacaaaagataatagaaataaagaaaacagacaaatgaaagactaagagaagaaatttacagcattcgaaaaacacattgaatacctagactctgtaatgcactccagcaaatcagtaagaaaaaaaaaaaatagaaaacccagtagaaaaatgggcaagcataaaagatctgaacagacaatttccaaacattcatatggcccacaattatgtgaatatatgctcaaactcactagtaatcctagaaatgaaaatcaaaataactatgagttattgctttccatgcatcagtttggcaaaaagtagaaagtggggccgtgccaagtgttagcaggaaattgtgaaactggaacccttatgtacttctggtggaatctagaatggcacaggagttatgaagaacagtctgctagtacttgttcaagttcagttcacatatactccataacacagaaatcctccaccttggctataaatacattttaggaatgtgtgtgtatacatatatatagggagagatactgcattttaaaaaatgaagatgaatggagatgttcattgcagcattgtttataaggtggctgagagataaaggctacctagctgttcaccaccagggcaatgcataaattcaatagagtgggtgtgcagtatagaattatagctacaagctagatatgcatccagtaacatacacatgtttaaatcagtgcagactgaaaataaacagccttctaaacagagtgagatattgtgcacattattcattaaattaaaacacatgccacacataaaacaacatggcatcatttataaggaaacatttacatatttaatatgtcagagtcattgtctagggcatggtggaaaataaggataaatgggaacttttaaaaatcttgttggaagaaggtgatggctcaaataagatttccttcctccctgtctctctctccctctgccccttctttcctcccttcctccaacagatgctaactggatgatggaatgaacaagattctgtgttaagtgctgtggaggaaataaagatgatttccccattggcttggccttcaagaaccttaggcaagggcctaaggtgaatacaccagaagccttagtagcaatactctgtcccagagttcagactcataaacacattcctgctctgcttaaaatcaacaaatgctgttttggatgtgtaagagctcttaaggatgacagcaacactcagtaaagtaaataagctacgtgactgaggccagaagtgtcacactgccgtctctttccttagcaggcttttctgataatacatatgacatagctctcaaatgcaaatgcctatagggaccaggaggaaataccaatggaaaaagagggtcaaatttaagagagtagggagtggtggggactgtgacaaaatggagcccatatgccttgacttaattgggccgccactgttcagtgccagctggttgctgccatgcaagaataaggcaatactcttgtattttcaagaaaagccaaaaatctagatttttatgtgaaattgtctcatttttaaatattggcaactacctcaaatatttttaaaccctagggagtggggaaaacaattcattttgtttttaaccacatttggtcagttggctaacaatttgctgcttctaatactctcatagcatctggatatctggaaactagtgatattttttaacctcattgtttatttttttaacctttcattatttgcacataccgaaaagaatgaagggaatgagtttagataagatgcaaatttctggcacctgtagccagataaaagatacaatgtctaccatttgctaagcaccatacaatatgctttgatgtattagagggagcaagacacctaggcctctatcctggagtgcctgtggcatttgagaaacaagaaaacaggcacccaggatgcatgtatacgtggggacattttaggactcaacatttatataaacactggagatatatatataatatatctctatatatctaatgtatatattatatattatatataatatctctatatatctaatgtatatatatacacattagatatattatatattatgtattatatatcgatatataatatatagatctatataatatctatatatataatatataatatatctaatgtgtatatatatacattagatatatagagatatatatatctctctccaatataaagatataaacaatagagctgatttgtgtattagcccattttgcgttgctgtaaaggaatacctgatactgagtaatttatttcaaaaagagatttatttggctcacggttctgcaggtggtactagcatggcatcagtatctgttccgcttctggtgaggccttgggaagcttttactcatagtggaaggtggagggccagcaggcacatcccacggtaacagaaggcgcaagagagatgcccgactcttttaaacaactagttcttctgtgaactaatagaacaagaactcactcataccatggagaggacaccaagccattcatgagggatccatccctatgacccaaacctctcccactagccccacaacactggggatcacgtcacattttaacatgagagttgaaggggacaaagtccaaaccatatcagggtgggattctgtcatcagatcaaaaagtccatgtacagaaagtacttcctatgtgcaagcctgagataagggctttcttatttaaaaattattaagtgtttcaggcatacaaagatgggtaaaacatacaaaagtagggtacccagcatcctgcttaactgatacaggggttggcaaacttttgctgccagatactaaataccttcggctctgcaggccacacacggtctctgttgaaactactccgcttaacactgtggtgtgaaagtaaccacagacaggatagtaaaccagtgagcagggcagtgttccaataaaactttacctatggacactgaaatatgaatttcgtgtcattttcacatattatgaaatagtatccttcttttgattattttgcaaccatttaaaaatgtgaaagccgttccagacttgggtcacacaaaaacagctgtgggctggatttggcttacgggccataggtagtgtcagcccctgaattaaagcactacatagtctgagccccccaggtgccacttccaaaattacatcccctcctacccccagagttagccattctcttgaaaacagtgttgatcattcctgagtgtaattttgtttttgtggaatgcatctgtgtccattaacagtacagttggttccaattcaaggattcagttaactacagatcaaaaatattcggggagtggggcaagcacagtggctcacacccgtaatcccaacactttgggaggctgaggcaggcagatcacctgaggccaggagttcaaggccagcctggccaacatggcaaaaccccgtctctactaaaaatataaaaattagctgggtgtggtggtgtgcacctgtaatctcagctactcgggaggctgaggtaggagaatcacttgaacctgggaggcagaggttgcagtgagccaagattgcaccactgtactccagcctggaagacagagtaagtctctctctctctctctctctctctctctctctctctctctctctctctatatatatatatatatatatatatatatatatggggcaaaaaaaaaatacagaataaaaataatatatgttttaaaacaatgcatataacaactgtttacatagtgtttacattgcgttggacattataagtaatctagagatgatttaaagtatatgggaggatgtatgtgggttatatgcaaatactctaccattttttataaggtacttgagcacttgccaattttggtgtccatggcggggggcgggggtgggtcctggaaacagccctcctgggatactgaggggcagctgtatttttgaactttatgttgaataagcatttaagttgctattaaaatagtgcttttttttacatgaatcatctttttaaatcttcaccgtgaccattttccagatgagaaaacttttgacttagagcagtttggtaacttgctcaaagtagtgggtagcacactgggatgtgaatttgcaacctttttacaatgggatctgagtttataagcaccacaccagcgatcgctacgttgtgtttcattaaccaagtaataactgatcttgccaaggatgaccttatgataacgacgtgctcacaataaatttagcctttctctgaagacaactgcaggttaaatgttactggttgtagttcagaccttggaaaattgctacgccatgtacagtggtgtgtgcgttaaccagaaaccttattttctaaacccagtgggtgggaatttattaatatttattttgagacagggtctcactctgtcacagaggctggaaggcagtggcacgattagagctcactgcaccttccatctaccctggctcaggtgatcctcccacctcagcctcttgagtagctgggactacaggcatgtgccaccatgcccagctaactttgttgtatttttttgtagagatggggttttgccatgttgcctaggctggtcttgaactcctgggctcaagtgatctgcctgcctcagcctcccaaagtgctggaactgaaggtgtgagccaccatgcctggccagaatttagaaggagtgactaccaacatggtgcaagaattagaaatgttttcaattaaaaaatgagaaagaccaaaggagacctcatccctactctcccctgcccgccccccataacatattataaaaatcatgggtgattcaggagccagtatgttctctcttggtcaggtccacagtgatgagctgttgagtgttgccacctagagagttgttaatgacacttacgccttttgagcttttctccgtccatgcaagtagtaccgtgtttgtttgtttggagatggagtctcattctgtcgcgaggctggagtgcagtggcgcagtctcgactcactgcaacctctgcctcccgggttcaagcgattctcctgcctcagcctcccgagtagctgggactacaggcatacgccaccacgcccagctaatttttatatttttgttagtagagacggcatttcaccatgttggccaggatggtctcgatctcttgacctcgtgatccacccgcctcagcgtcccaaagtgctgggattacaggcatgtgccaccacacccggcctgtttttctctcttaaccacagtcaactccacgttctccccaagcctctggcttttggaaatctaaatccaaacgctccctctctgcctgtctgtctctttctcagctgggaagttgccctagtttgctctggctcatttatatgacattgaagagagaccaaaatataatttttctaatggcaaaatacagcaagaaggaggggaatgttttaatcaactgggtgtattctccagcggggagcaagaacttcattttaatttctcatttccctttgatgaaaagttgagtgaatttttatcatgtagaatttataagaagtctgggtttaggtaatcagttgtaatatttatactcttagggaaagaaataggaatcattagcaagcatgcataattaatgaataaattatatttccctttgttttctttcaggtacaaggaaatggtagaactagtgatctcacccagcctcactgtaaacagcgattgtctggataaactgaagtttaaccgtgctgacgctgctgtgtggactctgagtgacagacaaggtaggcttcctgctgtgagtttgggtcaacaggtgtggtggtcctaggtcaccctgagaatatcgtaagcaacagacacgcatcctttccaaagtactgtccttaggacaatttctccccctgccatttaaatgcttgcctctgaaccaaaactttggcatacatctctaacaactctgtctcatcgttagaggtaaaaatgtgctcattcgtgtcttgaacttcctttcttggtctccaattccaagaaatgctgacaccaccacggatgatagtcactttggggcgtgtcccaggcccagcccttggatgtgttttgcagtgtctgtttctggctctgagctctgtcctctctactctgctctgccatccccttgtccaagcaggcgtcttgcttacaggggtttgacattagggcaagaactcgtctgcctcttgctttcaggtcgggttggagtcaaggaagcagagaagaattaaagttgtttaaaaaactattggcaaatgatgcagtcgaactagttttcactagaacaattccagctattgtttgttctgtttcagatctgtcagccttcctggtagagcttggagttagcaaaaggcattaagctattatgtttaaccattgggcttaaccctttctttggccagctttgggatttgctgctgttgtcctgagaccccctcgttgtttttccttcattatctgtttgacaccagctcatgggacacaaatgctatgtaactgtcgtggaaaaccaaagtgacacgtatctagtggaatataacatcacaaggaattggctttgaagccaatccaggcttccatgagtaattattgctgtcagcaagacaatgacatttctccttgcatgctggttacagagctggaactgcgctgatgaaagtaccaccagtggcttgggctctcatgccaaaactggatggtgaagaacataccctcattcttcctggcactttggaccattcgtgtaaactgcccaggggcctttgagagtttgagaaaatttactgagccccgttcaaagacattcatcattttctttccaaatagagacacaagtcaacttaagtagagacgcaagtcaactgtcttcatttgagagcccgtagtaacaggaaaggacataggctgctcaggggggaatcccagcccactgcttctcagccaaatgatctcaggcaaactgtttaacttttctgagcctcagttttctcacctgtcaaatgggggcataatggcgtacttcatagggtgctgattgcaagaaggaagtgaggtgatgggatgtaaagtgtctggcacaccttgggggcatggtgcatggttaaatgtaccattccattgtcactctcctctgaaccaaataaccacagtaaattcaaaaccatggttgcacacagggcagcccacagccacatctggccctgaagtttgtctttgtttggtttacactatgttttaagtaaaagtgaatttgtaaaaattgggagcattcacataaaaatctggagttctggtttatcttaaaagactgaaggctggctgggagcggtggctcacacctgtaatcccagcactttgggaggccaaggcaggcggatcacgaggtcaggagttcaagaccagcctaaccaacatggtgaaacctcgtctctattaaaaatgcaaaaattagacaggcgtggtggcacacacctgtaatcccagctacttgggaagctgaggcaggagaattgcttgaacctgagaggtggagtttgcagtgagccgagatcgtaccattgcactccagcctgggcgacagacgtgagactccgtctcaaaaaaaaaaaaaaaaaacgctgaaagctttagcaaccctgggcccccacattccccgctggctgccaccagtaggagctgagaggctgctgtcctgtagatgaatccccgcctctcccttttgtccttaattgttatgagcacatactttctgccaggcactattcaaagcaacataaatctagattcattctcctcctccctccctgtcaccatcagaacaaacactcggcacttgtcgtgtcccagcattgctctattaactcatttaatcttcacaactctaaaaagtgggtactgttattatccccattttacagacgaggaaaccaaaatgcagagaggttaagcagcttgattgagatggcacaggtgatagcccagatttgaacctagatagtctgacttcagagtttattctcctgatcagtactctgtactatttctcatttaattattatacaactggtaggctatgagcccattttacagacatggaagttggggcatggaggagttacgtaaccaggttaaagtcacaccagaatcaaacccaggcactctggttccagagttcccacttgtaaaccacttctaactcactttctgccaagctgtaagagtctccagaccctggatcttcaattctcccacagtggtgaaatccacagacacactcctttttgtgacttggagctgtcagtgccctttctactgccctggaacaatctggctgccatggtgaaggctttgagggtggaagcgatgaggcagagagaggttgctcccaaattcagaacaggtagcgccagtgaggtcaggttacacacacacactttctttctcatggggcaggtggtgagctccagagactctgcaggggacattccaccctggagcatgacccccaagtgctggattatgcctctccccctgcctggcctactgttctccctcctcctgggccattccttctattacagagtctttactaggtggcttcaaaggtcctactcaaaggaggacccccaagagtcatgagtcacaggacctgcactcagggggattctggagggagcatggagccaagaagccccccagtggcttccattgcattcccacctctgcttcttaccagctgtgggaccctggctagtggcctaacctccttgagacccatttgccccatctgtttaatgggagtaattattccaccgacctcacagactcaatgtgaggatgaaatgagttgaaacagggagtggacttagtgtgcttaaaaagtatagaacaagatctgaattccttatccttggccaccaggccccacttgtctatccctggaagcctcccaaactcatctccgtccctattgcctttgctccttgggcccagcccctggccccttttcctttgctttaactgagaagcatgattctgccctccgagcctttgcatctgctgtttcctctgtctggaccagtcttcacccaggctctgcaggaccagccctccctcagttctcatcagagaggtctttcctaatgaaaggaactgccccttccttcattcatttgttcattcatttattgaacaaatgtttaatcagccatgtgcttggcatggttttaagtactagggagacagcatagaaaaccctatcctcatggagcccacgctagggtgctgacaaagcaaaaagctgacaatgacgataaagaagcaaagtatttagcacgttgcatagtgatgcttgctgtgaaggaaaaaggcaggggaggagcatgaggaatgcaagagtggagggttgcagtttttgttagggtggctagaaaagaggtccctgagaagataacacttaagacctgtaggaggtaagggagggtgccacatggctacacagaacaagagccgtatgcacagagaagacagcaagtgcaaaggccctgaggcagcagtgtgctcaaaaaactttacatatattaatacaaacatatgtacatatgcatatttaaatttctgttcctgtttagcatgcaacttagtgcctggctcatggtagatccttaaaaaattatttctgggtgagtgaaggggtaggtggatgaagacagaatggtgctgaggaacccagataactttagggagatattggttctgaatccttagtaaagtttccttcacttccccctgcctcattttctacatttgcatcgtactgatgacaataatttccttactgcgttgttgtggagaataaagagatcatgctcatgcagtccttgccacagtaaccctggtttgtttgtaggaaccacttgagaaatattacctattattccttatgattcaagggaaaaatggatttgaattgattgtatcctgtctctgggaaggggtggtggggagttcccctgaatagaggaaaatttttcttttaaaatgcacatgcatttttcagaaactgatgctctaatctcattgtttccaaggagaggtgaaaccaccaccctacgctacaagctgggctgtcagctgctctcacttcctgcacctcctctgccctgggcatgacaagacctcattttcagtttcagtctcaccggttccaacccggggctgacgggttttgattcatttcatccaaaccaggctgagctgcccagagctttgcccaggtgctggcctggggaaccacatgtcagcttcatccttctcacctttaaggcttttgtagccgttcacacccagaacaacctctacctgtgcagaacagaaatcccgctttgtgggaggaaatggtgctattaatcccatcgtggcctccacaggtaaagagcttccactgatggcagtagctcacaaatgtcatagtctcgagccactttctggcgtatattcagaccacctctactgccacttggtactaatttgttcttttttttttttgagaccgagtttcgctcttgcgaaccaggctggagcgcagtggcacgatctcggctcactgcaacctctgcctcccaggttcaagcaattctcctgcctcagcctccggagtagctgggattacaagtgcccaccaccacacccagctaatttttgtatttttagtagaggcagggtttcaccatgttggccaggctggtcttgaactcccgacctcaggtgatgcactcgcctaagcctcccaaagtgctgggattagaggcatgagccaccgtgcctggcctgttgtttctttaaaacaactcctttgaaataaattcattttaaaaggatgacttaagccagttccagaaatgaaacgttatgactttgatggtcttgttgtgattctaatgtacataaaattaatttgcaacgatttcaatcaaagagggagtatttatagactccctaaaatcatcgcagtctgggacttgcagcctcattcctttctgtcctcagtggcacctcccgcaagagacaaagggcttgctcatggtcacagagcctctcagtgacagtcagaattggggcacccacttctggatgcctagtgtggtgtctttccagctgtccctgtccctagtatgggagtgatttaaatcacccacacaaggaagatgaactgatacagtttacagacatttacctttatagcagagacctgcctggagacatctcgctggcactacaaattgtctcatctcactgggggatcccttagaagccggcccctggggtccaattaggcaacataacagccgttgctgctttcagaatcattagcttcttaatcctcccagtgagaggtgaaaaaagtgtgaacattcaaattgtgctcatggatttaagtggcttaaccaagggcccccaggagagtggaagctaataatagctcctctgtgctgagcacttaaccatttgccaggtacctgccccatctgcatatgtgcaagatattgccccaatttgcagatgagaaaactgagactcagagggaagaggtgaaggacacaaggtctcatggctgtattgcagcacagccaagatttaaatttggatctgaccccttaagcctatctgttttctttggaaagaacatcaacaaattatgagaatgggttgtagatttggcctacggtaggtgcatgataaacacttgttgactgcgtgaatgaatgaaacatggtgtgtatcctcgggtaagttgcttcacacagtcactcacatacacaattgcacataagtatgcactcagtatgcacagactgaagctttaatttcctctcttaaaactggatcttttgctttgcacatttatattgtctttgtggccccaatatgcacttgagtttgtgtcttctggaatggagatttctttttatgaaccccaaattgtgataatgcttagtgatgtgtagttttgtattagccagtggtctaaactcttactcctcaaagtgtggtttgtgaacctgcagcgtcagcatcacctggaggcttccttgaccaacaatcagaacctgtgttttaacaagatccccaggtgaatcctggttccaggtgcactggtctcaaatgtccattgcttcctttgcacctcgttataattgcagttaagtactcatttgtgtgattgtttgtcatccatctcactcactagacaggaggcttcgggtccataaagacagggaccctgactgccttggctcactgtattagtccgttctcgcactgccataaaaaaatacctgaaactgggtaattttaaagaaaagagatttaattggcttacagttctgcaggctgtacaggaagcctggctcaggaggcctcaggaaacttacagtcatggtggaaggcgaaggggaagcaggcacattttccatggctggagcaggaggaagagaggggggtggcaagtgcgaaactcggtctcaaaaaaaaaaaagaacaaattagtaccaagtggcagtagaggtggtctgaatatacgccagaaagtggctcgagactatgacatttgtgagctactgccatcagtggaagctctttacctgtggaggccacgatgggattaatagcaccctttccccccacaaagcgggatttctgttccgcacaggtagaggttgttctgggtgtgaacggctacaaaagccttaaaggtgagaaggatgaagctgacatgtggttccccaggccagcacctgggcaaaggtctgggcagctcagcccagagaactcactaacgtgagaacatgataaaacttactcactatcatgagaacaggatagaacttactatcatgagaacatgaagccaggggaaaatacacccccatgcttcagtcacctcccaccaggcccctcctccaacactggggattacactcactgttgtaacccagttctgaactcatgcctggcaatgaatgaatgagctcagctgatccctctctcctcacccataggaagcttgggaagtagaggaggctcagagtttacaattcagaaggaaatagaggaggcactctaccctccctacttggcagccagctggcccgttatgcatcagccacagccccttcatcctgtgggttcattctcaagccctgggggaggatgaagaaggggcaaagctcagagtaaacagatttggttctgttgggcgccaggtcattagagctgctttcactaccagcaaagtggacctaagttgccatcaatgactcctccattgaccttgacctcatagcctacatggtccaatatgaatccatcacggcaagttcaagggcagcaacaaggttgagaacagaaagctatgatcagtgggaagtccacctccatctgccagacaccagatcccaaagagggcattgctgccttcatcaccctagagatgcttggagctcatctgaagaatggcatcaaaggggcatcattctgtcccttgtgctgatggtctgtgtttgagatgagggtgacctactccctttagatttccagcatgccatctgcttgttcccccagaagggtctatgacaaccatggcatcataaaagtactcatgaccactgcctgtgccctctctgcccatctggcaagctgtggtgcgatggccatgggactgttcagagtgtattcagtggcactgccaaggctgtggcaaggtcattcctgagctgaacaggaagcttgctgacacagcctcctatgtccccaccctcagtgtgtctgtccaggatctgacctgccatctagaaaaagctgttgagcacagtgacatcaagaaaatgtgatgcgggcacctggggggtcattgaaagaaattccgggctacactgaagaccacgttgtcgcttgcaactgtaacagtgatgcccacttctccacctgtcacactggggctggcattgcccacaaccaccagttggtcaagcctacttcctggtactgtgatgatgtttggctacaacaactgcagggtggacttcctggtccacatgacctctgaggactaagggctctggaccaccagcaagtgcataagaagaagaaaggcgttctctgctcttgggcagtccctgcccacctctgtgccaaagcagagaatctccacccttgacagtgtcccatccaaggctcccagaggagggaaggagcttagagagccctgccttatcatgtgtgtttatgataaggattatcaatgaagtccacaccaccctaaccatggagaaaggaagcagaaagggaggcagaagatcactctacatagagtttaatacactcactctccagtttctcaattcctccaggtgtcctgggatgaaaaggttaaatgcgattgataccagcagaaaacagaaaaaagcctgtgttttttcaaaaatcacacaattgccaaaggaaaatctctttgcacttacaaatgcctgtttctcgcttgcacagtcttcctgaggttgctggggtgggaaagggagagtatttacaggtctgcgtagtgggggaggggaacctgtctgctggggaaggcaggttgctcaattcagaggaactgggtggaagcttgaaaaggagctgggtgaggcaaacatgcaaatcatgccatggagattggcagaaaagacgcttgcctccaatttatggaatgccaagttaattcgagcccataggaatgttgttcccatagatttagatttttatgaatatatacatatttatgaaagaaaacatttaaagtgtttaattcagtaacttatgcagtactaaatgcactcaagtcatgggcttttacgaggaatgagattgtggctgcttcagaatgagacagttcattcttgagccctgtgggaggatgaagaaggagtgatggggtacaggacaccccgcctaggagcaaacccagggtagggaaatcagcattgagtgagcacctactgtgtgccaggggctttccttgacattcggctactgttgttccatccttttctttgaatgtgatacatgatgcgaaatatatttctgcattgttgaatgcacgtgcatgcacacacaacacattctcacacctggacctgcaacaaaagggttacacaattccttcttactatgggcaatacctgctgccatcgtatatcataaaataggcaattctccttttcttaattccagttatgactctctaaatgaacttcaagaccaccacccccgccccaaccccagtggtttgggacttgaacagaatttggctcagccagggggagggcattaagagtgttgaccttggactcacacagcttttgggttcaagtcccagttcccttgcccacggttgtgtgacttgaacaaggcacttgaccttcggagccccggtttcttcatctgtacaacggggttaatggcatcgcgtgctcagagcgctgttgtgaggactcaatgagagcctgtctataagcagttaacaagggcctggcacatagtcaacctctaagtgaatgccagctgctcttatgacaatgactgtcatcgtcagctgtagtgtcatggttgagaagacagactctggagccagaccacctgggttcagatcacagatccacaccgtacttcctgtgtggccctgggtgagttacttaagctctctgtgcctacagctgttcatctgaggatgagaatagaacctttctcacagggtacttatgaggattaaaataattaatccaggtaaagaatttagaagagagcttggcacgtaataagcactgggtaaatgatggctatcagcatcatctcatttaatcctttcctgtccttgcaagataagtattttcatcctcattgcacaggggggagccctgaggcccagagatctaggaacttgcctgaagtctcataactaggaagtggcagagttgcaagtgcacgttggtctcctgagcctccagcgcagaggctgaggcaggctcagagctccacagccttaggttgtgatgatgacgcagccactgccctacagaacagggagtgggcattggcaggttgacgctgttcccatcagtagacacattatctagaatttgtccaggactctgcagtgaggacattgagttgcattgttcaagatgacggagcacaaaagtacttcccagtgaactgtccctatgtaaaattatccccgggcaaacgtctctcccagcttaactctgtcaccttttcgtcaccccctgcatatcgcctcccatcaatgattggacattgtgtgctgagtgattgggtgttaggtacttgcatcaggagcccaggtgtcatccatctctctgctccaccaccctagatggagcttaggagatgatcgaagtggttccttcccctaaagtgttggggccagctgcacctgcactccatggactggaagtgaggaggcaggggaggaacatcaaagccatgtcattagaagaagggaaatggaggttggatgagcaaagccagcctgtgtctgccattctggggttcttggggattgcttttgaggcagggaagggagcggttttccatccaggagtggaaatggcaccagcttgattcacttcctagttgtgctgctgcctggtcatgtgacttggctcaagcacattctttctgtctctttggcctcagtttctccatctgtacaatggatggagaaatggactctactctgatgtttcaaggtgctatggattctttagatgtcatttttccttaactgcacagagacgaagtgcacccagaaagggctccgaactcctcaagaagaagagtgctgagatgtggcgcctcagataagcatctgtggtggagaaagccgcgggcagcacccctccaagtctgctcctgcttaagtggtgtctgaagtcaccacctctgcagaacatcaccctaatcgctaaaactcttccaatttttctttttctcctgcaggcatcaccaaatcggcccccctgagagtgtcccagctcttctccaggtgagtgccattcacttgtctcctgctcacatgcccaccttttcttctttcttggaaggtagaggttaagagagagggccctggagccagattccctggataggaatcccagccgtagcacttcctagctgagtgagcttgagcaagtcactccacctccctgggcctgagccctcccatctgggagcgggggacagtcatgctgcctgcccccacgaaaccagcaaaagcaggtaaaacacacttagaatggggcctggagcagagtgtcctcagagtcttagctattattttcttctttcttctcttcattcttttttttttttttattcttttctttctccccttcctctgctttcccatgcatagggaatttcttaatttttccctccctttttgccactgtctttctttctcctttcctcattcctttcctttcccttcttttcaatctcccttctattttttttttctccgagacagagtcttgctctgtcacccaggctggagtgcagtggcgtgatctcagctcactgcaacctctgcctcccaggttcaagtaattctgcctcagcctcccaagtagctgggattacaggctcccttctttctatccttatttttctctccctttttctctttcccttcctctcttccctcccctttcgtcccccatccttttctctccacctctctctcccttttcccctccctcctttcatcatttctttactttattttaagttccagtatacacatgcagaacatgcaggtttgttacataggtaaacatgtgccatggtggtttgctgcacctgtcaacccatcacctaggtattaaattcgacatgcattagctattcttcctgatgctctccctctcccctacccttccctaacaggccacagtgtgtgttgtacccctccctgtgtccatgtgttctcattgttcagctctcacttgtaagtgagaacatgcagtgtttggttttctgttcctgcattagtttgctgaggataagggtttccagcttcatctgtatccctgcaaaggacatgatcttgttcctttttatggctgcatagtattctatggtgtatctgtaccacaatttctttacccagtctatcattgatgggcatttgggatgattccatgtcttggctgttgtaaattgtgctgcaatgaacatatgcgtgcatgcatcctttcttcctcctctaccattcacacatcactcctcagtacctaaccccacactgagccctagaaactcagagatggatgagatgcagtctctgcccccggagagctagtccatattgatggatgagacaccttccaggactggggctgacatctccagctcaaatgagtttcttatgcattttgcagcaggttcccccaaataaccctttatcgtggcagtagtctaaaagaaagaagggcatagggacatctgtttataattccataaacttttgcattcacctgctgtgaggcctcaggtggaagaggaactctggaagcaaacaggctttagcaaaagtgatgtaaccaaaatggaatcagatacagattggggaatctcatcaacatttacctgtacgcttaacccagttgtgacagttagaaacatgatagttgtggtgtctgggggagggtggcatagtggaggggttgagggtgtggcctctggagccagggttcaaattctctatctgctgtatgcttgtggcgtgttattaagtctctctctgcctctgttttcttacctgtaaaatggggatagaaacaaaaattacctccaaggcttatcacagttgtggtggagtttaaatgagccaattcacatgaagtaaataggacagtgcctggcacgtaggcatgagaattgactacctttaccactaagggaagtggcccttgtaggcattgttgcagacaggatgtgattcggtctcaagaggtggctgctgctcaaatccagctgatagcaccacacaggcgtgcagacccaggtacgctgaagcacctgcttttcaggagaaggaagacaaagcgagtgtgtttatgtgcatgcctgcatgtgtgtgtgtatctgtgcacgtaacctcctggttttcaaattttaacaacaatttcaaattaggaaaaaaaataacttcactggtcaaagaaattatatccatggatctgtggattggatgtggcccctgggccaccattttgctccctttgtgttagaacaactgaccttgactttatttattgctatctgcagggctggatgaatcctagtcctgtgaggaatagcagattcatggttccaagcatgggctctggagtcagactccttcatttaagctctatatttaccactttgtagctgtgttttcagctctctgagttttggtttcctcatctctaaaccaggagagataagagcctccaccccagagatttgataagagcatccatgagatataatgtacataccaggtgcatgtgacacaattcccaacccttagtaaaaaacacaatgcttggcagcacccatagtataaatatcttaagtaaggagccctgtacatcctagcccattatagaacctgttgttctccatggagtagagaagtcatttgtggtctttggttgcaagcaacagaaatcaactctggctgatataagtctaaaagcatttttgggggaatatctggaatagctcacaacataaatgaaataatcaggcctcgagagagattaagaatgggacagattcaggattcaagcaatatggaggatttaaattcccagggcagagtctgattggatgatcttgcatcatgtccccaccccttagctaagagcaggacatcttgattgacagccctgttaaagctgcagtcaattgagaaggtatctaaattaggacaatcggggtaggataggctatgctacagtaatcagtaaacctcgacatctcagtggcttcacacaacaaaggtttgtttcttacataaagtccagtgtggatggggtgaaaccctgcaaggcagctctctctcctccacaagctgactcagggatccagggtgtttccgtatcatggctctgtcatctcaacctgtgccctccacagttgctatcaaaagaggagaaaggacaggagggttgcgggggatgtgttcattggccaggcctgcgagtggcttacagcatatctgcttacattctacggggctgaacccagtcacacggctgaatctgactgcacaggagacagaaaatgtaatcttcctgcttcccaggcagaggaaaataaaatgggatttggtgaacatgtatgttgtctctgctctggaaagagtagaaccccaaagaaaaatgggggtgttgatatcaagataaggaagaaggggtgccagactgggcctggagatttaatcttccctctttccacacagatcttgcccacgtgtcctcccccgccagccttccacagccatggcagcctacggccagacgcagtacagtgcggggatccagcaggctaccccctatacagcttacccacctccagcacaagcctatggaatcccttcctacagtgagtagtaaacaagtccttactctcctcctcaggtccccaaatcatggtctttgttctgcactattgtctcagctaaatgtggattaatagacacaaccaagctgattttggattagagataaagggaaaagagtaacactttaaatatggttcaaattctatagcctataatatcaagatcccttttgatggcaagaattggaaattgaacccaagctggtttagggaaaattgggactgaatgatttgcataccgagagatctgtggatacagctgtcatcaggtatgactggatctaggtgctaaagcgtcatcgtgaggtgtaagtctctttccatcttcagatgctcccagcaagttctccctgcatggcagcaaagatggtgcctgtccactcaaggtttgcatccttttatctctgcatgcccagtggaaagagagctcatctttcccagaagttccaacagaatcccatattggccctcattggcccaagttgggccatgtggcaatgcttatagcaaggcaaggagaacagggtgatggagataaggaagctgaagcctatggattatctttgaaggaggggtggttttcttaaaggaaaacagagtggtagtatcagaagaaggagaaatggatgtggtggaggacggggcagaaacaacagacctccagcccttgactgttcacatcttacagctaagaactgaagacttgcgaacctggctcaccatccatgcccacctgcccttgcctctggccttgagtcatgctattccctcgcctcctagctgatatcttaaccaaagcccttttagtagcaagtgacaaaaacccaagctaatcagctggaggaaacaggggaatttattgcctatgtagctggaaaaacctagggcactggcttcaggcaggcctgggtccaggtcctcaaggtataatatcaggactcagcctctgcttccctttctgtgggcctcaggctcaggcaggctctcccactgtggtggcaaagacagccctggcagtttcaggctgcagtgtcccccaaaaagagagcccctcctgtctaggacttcctgcagagtcccaggaatttctctactggactcccacatccatccaagaagataggtgctgtgggtggccatatttggccacatgtccacccgcaggaccaggggtcaggtcagcctcacccaaaacaactgatctgaaggtgaggcaggggtggttcacaaaggagaaggaggcaggaagaaactacagatagccactccacgtgactttacagcccacccaaatccgggctatccagtggaaaggacgtagcgttggtggcagggacctgcctgcctgacttcgctgcccctgacctctccaggcctcagtttcctcaattgtaaaattaatatgctcgtttcatcttcccacctagaggggtcctgcttgagttgagtgcagaggctgactcttacatttctttcctccctcctcttcctccatacctctgccctgtttgtttgttcattcattcattcatttattcattcattcaacattgagtcatgtgtggggcagacagtggtcaacaaagcagagcgggccctgtcttcatggagattactgcctaaaaccgatgatcaggcagcactagactcacagttttggtatcaggggtcagtggctctatgtggacaaaagccctgcagacatttccttttagctttagtttgccacagtcctcacccagcccacgttactcccttgaattatctgccttttccatgaagacacttgagtttgcaaactctggcctagagatagaaaaaaaagtttttttaattttctttttttgagacagcatctcactctgttgtccagccagagtgcagtggcaccatcgcagctcaccgcaagctcaacatcacaggctcaagtgatcctcccacctcagcctcccaaatagctcagactacaggcatacgctactgcgccctgctaattttttgtatttttttgtagagatgaggttttgccatgttggccaagcaggtctcaaattcctggcctcaagtgatctactgccttggcctcccaaggagctgagactacaagcgggagccactgtacctggccccagatttttaaatctgtatgtgtaatttcaaattaggatgcacggcataaaggaagcaaagacttgttttaggttctagggatgggaaaggccttttaaataaggagcgaaattcagctgagaactgagagatagccatgtgcaggcacagacaggagagcatccaggcagaggggcaggccctgggaatggggaggaacttggcaattctgagaagactaatggctggagcacaatgggagatgaggtgaatgaggtgggcggggcctccgaggcccaggaaagatttggggttctgttccacgtgagactggaagccactagagggtttataagcagtgggtaataggatgcaacttaggtgggttttttttaattttattcttatttttattatttttagagacagggtctggctctgtcttccaggctggagtgccatggtgcaatcatagctcactgcaccctccacctcccaggctcaagcaatcctcctccctcaccctcatgagtagctgggactacaggcacgcactacctcccctggctaatttttttttatttttttgtagagacggggggtggggggtctcactttgttgcccaggctggtcttgaacttcttacctcaagcaatcctcctatctctgcttcccaaagtgctacaatgacaggcatgagctaccatgcccagcctaggttttaaagatcacactggctgctgtggtgaggctggctcagaggggatcaggaggagaagcaggaaggcccgttgggagacggatgaagcctggagcaggaaatgttggaggcctggggcgaggccatggcagcggacagacacatgtagacagaatcaagagcaactctagaggcagaattgacaggtcctgtcgaggcatcagtccaggcttagtaatagtcaccatcgttgacttcctgtcactcacattggtttatttccactaattcctttaatccccacctcaaccctacgaggaaggtcatctcattatcctcccttgagcgataaagaaacagagactcagagaggttaaataacttacccaaggtcacccagctggttggtggcagaggtggaattaagcccaggcagcctggctctggaccccgagccctcacccacggggctccgacgcctggctgtgcattctgtaaatcccgggggattacctatgacagaccttggccaacaggtgtgggcatcttttctaacttttttcccctgctgtgctagaaggcttagaatacaatcacacataagttaccccgcttggctgacagccaagaaaaatgaagccatattctttttcacataaaagagaaaactagccctgttcccagacaaaacatggcatcagatggaaatcaatttggtgcaaagttattttactgtctcagttacttttggagcgtctgctcctggatgatacagagtagatgataagagcacatgtcctggaattctgctgcccagattcacatcccacccttgcctgttgcaggctgcaagaccctgagggagcagcctcccctccctaaacctctgttttcacattcatacaatgggagtaatactaagtctacccctctcatgattgctgggaggattaaatgagatcatctacaccaggggttggctatcttcttctgtaaaggcccaggtggtaaatactttctactttgtgatccatatggtctttattacaactactcagctctgccattgtggcgtgaaagtagccagactgaatgtaaacgaatgggtatgtctgtgttccaataaaactttatttacacaaacaggcagtggaccagatttggtccatgaccctgatctagatgaagggcttcctcaccagggcccaccccaagagaaatgctcaacaaatgtcacctgtcccagtagaagccaggctgccacacacacacgcgtgcacgcacacacacatacacacacacagaatgtccatgtcactgaacaataacaggtggatgaaaagccgtttccctttacatctgcctgtgcctgagcaagctgtgtttgctcatcgtctggacaaaccttgttgaatcttgtcaggaaactttttacattgctccttggcaaatagtgctatttactttgtttaaatacctgcaggaaataacacaattgagcaaactagagacaaggacagttagtgtattgagtatttttttctcaatttattatgcaatattaaagacatacataatagagtaatactatgacacctatgaactgaccattcaatttaaaaaataaagggaggtggctttcctttcctctcaaagattcctgtgcccccaagtttcatgtttatcattcccctgcatttttttatgtagaagagatcaacaaactttttctataaagagccacatagtaaatatttttgtcttagcagaccacacagtctctatctcaatcactcaactctgccattgtagcatgaaagcagccatagacaaagcataaacgaatgggctgtctatgtctcaaaaaactttatttacaaaaatgaacaacagatgacatttggcctatgggctggagtttgctgacctttaatgtagagtattttaagcatgttttaaaactttacctacattgcatcttttagtacacattcttttgcaacttgctttttccacccaacattgtgtctgtaaaatgtatccctgttcatacaagtagctgtagttcattcattttcactgctgtataatattccactacttgatggcaccataacttacttacccattctttagacagtcttttagggctttgtttgtttctcattacataggatgctgcaatcagcatctttgtgcatttctcaggggtggaaacctatgagaggaatttctgggtcatggggtatatgcattcttcactatcctggataatggcaaagaattttcattgtctctggctttgtaaaaagccactccagaacttagtggcttaaaataacactgacgtattatttctgtgggctggccagttgggcctgctgctggtctcccacagtccctctcatgctgctgtgctcgcagcaggtgggctggggctgcctagatggcaccagtggggcctctctctcatgtggcccttcctctgggtttcttcaggcatggtgggctcaggttccaggaggctgaagataaaagcttcaaagcctccgggtgctgagtctcaagaactactgggcgtggtggcacacacgtgctcccagctactagagaggctgaggtgggaggatcacttgagcctgggaggtcgaggctgcagtgaactgtgagcatgccactgcactccagcctgggtgacagagtgaaatcctgtctcaaaaaaaaaagtagttacatatttattttaatatgcatttatatctacatatatatatgtgtatgtgtacaaatataaatataatatatataaaatatggaacctgtgatttcttggtcattattgcttaaggcaagcaaatagttttaaaattgagttgattttttttttttttttgagatgtagtcttgctgtgtctcccaggttggagtgcagtggcatgatctcggctcactgcaacctctgcctcccacgttcaagtgattctcctgcttcagcctcctgaatagctgggattacatatgtgcaccaccacacccagctaattttttgtatttttagtagagacagggtttcaccatgtttcccaggctgatcttgaactcctggcctcaaatgatctgcctgcctcagcatcccaaagtgctgggattgcagacatgagccaccatgcctggcctgatgtttaaaaataacatgaaatgaatcattatatggatggtgctggggtatgggaaaaccaagcaagtggtgcacaacattgaagatggggaagcactaatttggtccaaaaccctcattgtagtcacgaggaaactgaggcttggaaagcagagggcacctgcctcagtgataccacagagccaggacaggaaacgagtactctgggctgtgccatgtgccatgggctgatccaaattcacatcacggagcacctgctcagggggctgttgatattttaaacttgaaccatctcctgtctctcctctgctcagatccctccagggcccctctcaggatcaaagccaaaggttttccactgcagtatctttgccctgtccccaccttgatgatctttctgacctcatcactcaccctctccccaacccttaccccactccagcctcactggcctccttgctgttagttcatccaacataccaagtacactcctgcctgatgacctttgcacatgccttccctctgcctggacaggtattccttcgggtgtccacaagtcttgctcctttgcttccttcaggtctttgttcaaatgtctcttcctccctgggacctcttcctcctcctccaagggacctttcaggatcactctgtttgaaatttcaaatcccaactccccttaaccaactttgctacctccttccctgcttcattcttctttttagcaccttaagactctaaatggagtccaaaaaatttaatcatgtttggagaattgtgttagtttgaggttcataagatagcagggaaaagtgtgtgccgctgagtgtgccagggagtcagggagccaatcatgttgtctcttgtgttacccaaaaagtattttgtatgcttctcctctgctgtgtgtttttacttgtttttctgctgtcattctcctcccactagcatataagctccaaccgctacagtatctgtagcatcaagatctgtatctcctgacctgttgcaggtgctgagctaatagttgtgaatgagtgaatgaatgcttattggctgtctgttgttgacaccctctctgaaatccacatgctcactttggtgcttccatgagtggaagccagtggaacttgcagatagttcacgagcaccttttcggaggcctctttctctttgctgtgaagatacttatcagagatgcctgcggagtagcaggtctgatgagatcagtctgtccccaggccaaaccgtgaccagatttcctttgaacataatctcttagagcagtgtttctctatctggtttaaaagaccagtttttgggtttttgctttttaattgccattccactgtggactaatattttagtaaaaatgaattaccagaaaaatcaaattaaaatttttatttacttatttatttgagatgaagtctcactctttagcccaggctggagtgcattggcatgatcttggctcactgcaacctccaccttctagtttcaagcaattctcatgcctcagcttcctgagtagctgggattagaggtgtgcaccaccacacccagttaatttttgtattttttgtagagacagggtttcgccatgttagccaggctgatctcgaactcctgacctcaagtgatccacccacctcagcctcccaaagtgctgggattacaggcgtgagccaccgtactgggccaaattaaaatgttttaaaaacatactaaatacaagtctggagaaatggccttagatgtcagaacaatgccaagttgctgcaaaagtttcaggatgtttacttctcagtgtctgactttctcattctgaacttgtaactgatgcatggaccacagtctggacaacagacttaggggacgaaggccctcgtgcgcctttgccattttcatattctcttctctttctcatggattagaattttatgatccaaccccttcagcaaacaaaagaagagatgaaaaactttattttcttttctttcatagtcattcatttaccagacaatttttgagcacctactatgtgcaagacagggagccacatatggggagactgcagggtacaagagggaaccagccccgccctcctggagcctccagcctaaacagagagcagaggttcaacagtgaatggggttgagtgccaggcaggagaactgcatgctactcggggctgacttaggtcatagaagacctttctagggaaacaacatttgcctgatagagaagagggaggtgtggattccaggcagaggaagcaacatatgcaaaggctttgagtccaaagacatggttgcagtttgtctgtatcatctatttaaaatggacaatgtaggtacccttagaggcagcaacttttgtcttgtatccaaccaagacaaacactctgacattgcttgaggaagtatgtacatttcatcttggattgtgatagtaaaaactggaatcaacctggagttcatcatcagggaactggctgaacaagcagtgatatttccgattctggctttccatcccgtcactaaaacagagtgtctgagcatatggcttgggcagagggagcgaaggagcccaggaaaggcagtgaggtcggaggggtgggcagagcccatgcagggccttgggggtcactgcagagtttagattttactttaggtgcacagtgaggcagactgtacccaatgcaacgttaacgactcctagtggactgagcaaaaagaaggtgctgtataaatattgcttgttgctgccatcattgttgttactaaagtctggcaccatcgatggcataaaaccccttcacacctgttattgagaagcatcaaggtaaggaaccttgacttcagagttatccgccaattgctagaccccagtccaatggattggcaatctcaattcccacatctttaaaatgaaggaagtaatatatagcctgttttgtgggattgatgtgaggataaaagagatgtgttctttaattacttcattcagagcctttatatgttcattctttcctcttactttaatttcctaacaacccatcatttcacaagaaaggaggcctccaacctggggttgcaggagaaactttccaggtcaccagtcaatgaagcaaaccatctaggactccagcccagatttcctgactcacaatctatctgtttttaccttactaagcattctcttattttacggggttgacaggataagaaggaggaaatttcaatacaaaaaccatcagcagaactagaaatgttcttgaaagaaatgaaattttaaacagcaatgagatactgttctatacccataagatagacagagataagcaatgtttgataacagttgatgtggttgtggagaagcaggactcactcagtgactggagagaatgtcacctacaatctagggagcaccattcagcaacatccaagaagatttaagatgttcttgccctggactcagtgattccagctactgggaatttacctaaaagatagacttgcacatgtgcacaaaatgtgtgtgtgtgtgtgtgtgtgtgtgtgtgtgtgtgtgtgtggtgtgatgactataagctgcagcaaatacatatgtatatgcatataggtacatctatatgttaaatatattttctgcatgtatatatgtgtgtatatatacacatttgttgcatgtgtgtgtgttatgtgtgtatttgctgcagcttaaattacagtcataaaatctcaaaaccacccaaaagttaatgaataggaaactggttaaatgatgaggaaaccacacattagaatgtcacacagccatcaatacagaataaggaagaactttataagctcatgaagaataatcattaccacatattgtgaagcagtaaaagaaaaagaagaaaatgaagaacagaatttatagaatactcctgtttatattttaaaagatggaatagatatatacgttacatatatatattatatacataagtttgcatatgcacagaacctgtctggaagtgaactgtgttccataaagctggtaatcgtggttgcctataggcagaagagctggggtttgaggtcagggataggaagagactctttgctttatgccttttgtactattggaattttctacaatgcattcattacattttcagtaaaaattaagtgaatgagctgatgatggttagcctctcctcctcaacacagtccctttctcagccagttgttcatggaattagtacctatgctttaggtaagcatgccgagttttgctgaagcagaaggcagatttgtaactgtggccttgggattagcaggtccccccgtgagattggagagtgtcttacagttaagtgatatcatctttgcagaggaagggtggttcatttcacacctttgcccaaaatcctaatggacatttaagccatacacagcactactcagtggagtagtgggctgcaggcttgcatacctaccaagctggcaggtagcatgaagctcacggtggcatgtacaaaatatgagaccttcatacctaccaagctggcaggtagcatgaagctggtggcatgtacaaaatatgagaccttcttggcctgcctttcccttccccacttttgatagggtcctaggatgtaccaaaacaaatcacaactgcaatgagaaaatagcacgttaaaaccagcctcaaagtcctgcagatggaatggaatctatcatgacctgggaaacacctgaattgggagcccacaggggcagcttgtggtcacatgggttgcagacatggtgttactagaccatcttgtcattcaaaaagaagccgtaagtccagctttttgtatgaaatatcctgacttttaacaaaatcaactaattcagtttttcttaaaaatatgctggccaagtcaaatgtctataggctcactttggctgacaagccaccagtttgcaactcctcatttggaagctgataaaattgcatgctgtcttgacccagtagctcttttgtgggtgacaaggacgcatcctaatcatgtgtccttggtccttttttttccccctcttccttcaaaggcatcaagacagaagacagcttgaaccattcccctggccagagtggattcctcagctatggctccagcttcagcacctcacccactggacagagcccatacacctaccagatgcacggtcagtgtggcgctgtggccccttcctgcccatctctaaggaccacctaagttgggtgtccattcattcattcattcagcagattttttgagcacctactatgtgccaggctctatctcgaggagtggagaaaatagatacgagatctgcctttcatggtcgttacctggcagtggggagagactaacgataaagtcggcaaataagccagatgatttgggaaggggttgaatgtaataaggcaaataaacctggtctttgcataaagagtgatgagcacttgggaggtcaggaaaggtgagatttgtgactttagatcaaatcaccagggaaggctctttgaagagatgacattgggcagaatcccaaagggtgaggcagagcagccacatagacatcttagggaagagcattccaggcagagggaacagcctgtacaaactgtgcatgcagggaaatgtctggatgtattggaggcacagagctgagaccagtgagactggagcaaagtcagaaggcatgtaggaggagagaatcttggagaaagagcaaggcgcaatcacacatggccttgagggatatgggaaggagtttgcttgtattttaagtgtgatgggacaggcaagtctattgtagagactcagaaatgtcgggtggtggaaatattggacagtcgggtgaagaagctgttattccaggcaggaggatcaaggctctgcagccctagagggtggccttaaggaagaaagaactccattgtgtaaccctccacccacctgccataaggaactggcttactgggttctcccatgctcatctccactcttttaccatccaagaacccttctctgttctggtgcccccttgggagcatgctggagttgatgcatggagcagggggctggtggctgtaattatggggatccccattctgctgtttccctttatataagctgctaaaaattaccatcaagggtctgaaagggtaaaatgataagatggtgggctgatgtgtgattgtacttttttttgagatggagtcttgctatgttgcccagactgggctcaagtgattctgccacctcagcctcctgagtatctaggaccacagctgtgcgctgctgtacccagctttgatagtatttttcttttaaaagcaactacttggaagtactatcacttcatctttattattttaattttttattaaggaagtaataaaaatgattgtcaagggcagcatttcaggaaaaaaaaattgtgaaaggagaataaataatcttaggtatgtgtgtagggaaagcaggtgataagcattcatgcccagccctgagaatagcttcctggtaaggtctgtgtccaagtttgtcagtgatgccatgagccagccttgaccaaacatgctaggtgccaggtgatgctctgtgggttctctcatacaaccttcatgacgctctcaagcaacggtactgtattattcccatttcacagaagaggaaactgaggcatagaaggaatgactgatttgtccaacaccagggcaaggattttagattttattgtaagcataatggcaaagggactgtgtcagatgtcttgggggcctggtggaatcccaacccccagcctcactgcaaagcccatcgctgtaaccccggcactttcctgcctcctctgcttctgctctcacgtctgtgtccccagtcgggcctttctgaggcccactgaagggagtaaactcctgagacccatctctccaagtggggagtgaatgatggcaccggccctgataacaggaggtgtgtgaaggtactgaacttcaacttgtatttgagtccatctcaagccagtttttttccagctctttaaatagaaactggacttactgcctcagggcttctgaggccacagaggttgaaatggagacccggtccccgtatcccattttgacaccccctcagccacacaataagtgatctaagttatgtaggagaggcccccattcattcattcattcattcattccgtatgttgagcaccagcttgacacctggcacccttctaggcactgagggcacagcagcacacaaagacaatctcctcatggagaaagatggacagtaatcaattgacaagtagatagataattatagattttgataaagcctgtgacagacaaaaacatggtggcatgctggaccgtgagcagtggtatggaccaggagtggtgatcggcattcagcaggtggtcaggggcctcccgatggaaaggaggctgccacaggaggggccagagctgggccgggccgtacaggcagcgggaacgcaagagcaaaggccccgcggcaggaaaaggctcacagtgttcaaggactccagaggagcctcatcctatcctccccagagcaggatatgcagaataatattctttcttcttacagcaaccgcgtgaggtgggcaccataagccctgctttcatagatggtgaaagtgaggctcagagagggcaagtgacttgcctgaaaccgcagagccaataagtgttcagagctgggattcagactccagtttctctggtgccacttcctctaaatgatgagatttcctggactccttcaggactccaggaactgtcctaatgtctgcacataaacatgcggcttaatctccccagtagccccgtgacatgagcactgccactgccctcatcttacaggtggagaaactgaggcataaaatgtttcagtcacttacccaaggtcacacggccatggcagtgggaaatgagccaggcagtcgcccaggcacataaccctcacgccatcctgcccttcacactctcttagatccatctagaaggtgattctcaggggtgagcctagggccccaccccccacctcaatccccaccagccaacgtctccagctctcttctcgccctaccatgggaatcgtccaggttattttcttatcctcctcacagcccagatgacagaagggcagcggcagcagctgggcttcgtcccaattaactgccttcagtctgatgctaatggctataaactgctcttgagacagcccaggcattttgcaagcctgacatattcctccttaagtatttttttcaaacacaaacacacagaacgctcacacaccatgcccatgtgcttcctattaactttttttttttctgagttgttccagaggagaaataaactctcgaactactgagagcatttcagaatggaagacattggttgagcttagtttctcagaggaagaagaaaataaagaagattgaggcttatgaacttttaggcctgaaaatgctgattttgtgaaattggcccatggtgagaagctagcatgagtctttttcctttctaagaatttaaaccataattttggcccataatcccagcactttgggagaccaaggcaggtatatttattgcttgagtccaggagttcaagaccagcctgggaaacctggtgaaacccatctctacaaaaaaaaaaaaaattatctgggcatggtgatgcatgcctgtagtcccagctactcaatatgttgaggtaggaggatcacttttcagcctgggaggtcaatgctgcagtaagccgtgatcatgccactgcactccagcctgagcaatagagcaagaccctatctttaaaaaaaaaaaaaaaatgctgggcatggtggtgtgcacctgtagttccagctactcaggaagctgaggtggaaggattgcttgagcccaggagttcaaggttgcagtgagctatgatcaccccactgcactccagcctgggcaatacagcatgaccctgtctcaaaaaaagaaaaaatatataatttttagaagcaaaaaaggatgctcttggggctcacctcatcattttacagatgagtaaactgaggcactgcaacagagtgtcttacggaagatcacagagcaagctttagacaagccaggatgcctcccactaggtcttctagctaatctcataaacttccaaaaactttagcacagccatcaccccgtaaggccctggtttgagatctgtatctgtttggataacactgcccctccatggaatatacaataaatgtaaaagaaaaaagttcacagctcttgttcagcctttgcagagttgtttattttctttattttaagttcaccctggggtttttatagctgaagtgtgtttcttatgggtttgattttttttctttttggcttcttctggtaaaacactgctattcacagaaataaccacaaagattaaaaagagggggaaaaaaatctccagagtgtgttataagaagtttctggtgccacagagttgttaagagttctggacctggcctgtggtcagtcctggcagtaccccacacacaatggcatgagttggggaagcacatggacttctctgtgcctcagtttcctcacctgtgaaactggtatcatagtgagagaggtgacaacatgaggctttgggagactaaataacatgattcatgggcaccacagatgagatccataaaggctagattttctttttattatctctgttattccttccttagcatggtagttaaaaacaactaaaagcagggactctgaagtcaggttgagttaacctccaaatacggctgcaaaccagccctgtgaccttgagctcagttacttctcagtcctccagtttccttccctatgaaatggggacactaagagtactttactcgtggggtgctatgatgactaaatgagttaatgtatgtgaagtgtttagagcgcacctggcacaaactaacgctctctaaacgttaattatcgttattatgattgacattgttagcctcacttcaggtttgatgggccatgttctttccaagttcgcttctatttcctgaactctcaattttagtaagtggtcagggtaagagaaaagaggaatactaatctgagactgtgggactgtctgcatccacataaactccccttccagtgaactctgtgttgtagggagacttaaaaacaggccaagtgcagtggctcatacctataatcccagccctttgggaggctgaggcgggcggatcatctgagctcaggagttcaagaccagcctggccaacatggcaaaaccccatctctacttaaaatacaaaaattagccgggtgtggtggcacacacctgcaattccagctacttgggaggctgaggcaggagaatcgcttgaacccgggtagtggaggttgcagtgagccgagatcacgccactgcactccagtctaggcgacaaagcgagactccatctcaaaaaaaaaaaaaaaaaaggcaagaaaacagtgggatccctatccagtggaaactctttttgcatttatgaagggccagggaacataaagactgaagcttagaacccctccagcagccactcaggagcaacatagaatcgtgcaattcagggatgtgtaggaaattaaaagttcagtaaaagcacttgttactcagtgatctcagctcgagacctccgagactggattgtgttggatttagaaagtctctgtgtcagattcatgaaatctaccaccagtaaactgtgtgaccttggacaagtcacaaagccttcatgatctgtgttccacagttctagtgctaacaagagttccaggaaaaaataaaggggttggggcgggtcatggtcatacataccaaatacgtttagtcaatagtgcatgccacaaagttaaaatagacatctttgctacaggacttttcagagcctttgcaggctgttgtgccttgtacttctccaggaatagaattcaggaggcaattttcccaggcagatgggatgagggcccctccgtccaaactcgttctgtggtcactgagaagccctggatgtcatgatcttttaggacccttcctttatgaacgttctttgaatttctattgttttaaacaatgaacatgtatgtttttctttttcctgtgttttaattaaattgtttcttgttgagatggagtctcactttgtcgtccaggctggagtacaatggcatgatctcggcttactgcaacctccgcctcctggattcaagcaattctctagcctcagtctcccaagtagctgggattacaggcgcctgccaccacacctggctaatttttgtatttttagtagagatggggtttcaccacgttggtcaggctggtctcgaactccttacctcaagtgatccgcccacctcagccccccagagtgctgggattacaggcatgagccactgtgctcagccttaatttttaactgagatataactcacatcctaaacttcaccttttttttttttttttttttgaggcagggtctctgtcacccgggctggagtgcagtggtgcgatgacagctcactgcaacctctgcctcctgggctcaagtgattctcccgcctcagccttccgagtagctgggactagcaggtgcctgccaccatgcccagctaattttgtttattttttgtagagacggggtttcattgtgttgcataggctggtaaacttcacctttttaaagtgttcagtttagtgtttttagtatattcactaaaattgtgcaaccatcaccactatctaatgccacagcatttttgtcaccccgcaaagaaaccccatgtccattagcgtcactccttagttcccctccctccgatatattccttttgtaataaaaaaaaaagacacatgaattttttaaacaggttacacatttacctagttcgggcatctgtggaaatctttcttctaccctcatgctacatccaccccgtttccaaacccctaacaattaaccactgtaataatttcgtgggaacccacccagaacatctttttgcaaacataagtaaaatataagcagtctattatattgtatgttactattacaagaattagttcagacgtgattcataaataagaaaactatgttagtataactcggaagttgcattgtttcatttgcttctaagggtttctctatcactgttgttgttgttacgtgccttgatgtagttttctttatgattctcgtgctctgtgttcattgagactcttagatctgtggatttatcatttccatcaaatttggaaatttttcagccaatatttcttcaaatttttgtctgatgttccacaccactacctcccactccaagttcataaatcttttcttctgtagtatctgatctgctgctaattacatccatgtcatttttcatcccatacatcattttcatctccagaagtttgattttgggtgttttttttttttttttttttttgaagacagagccttgctctgtcacccaggctggagtgcagtggcgtaatctcggctcattgcaacctctgcctccagggttcaagcgattcttatgcctcagccacctgagtagctgggcttacaggtgctcaccaccactcctggctaatttttgtatattaagtggagatggggttttgccatgttggccaggctggtctcaagctcctgagctcaggcagtctgcccacctcagcctcccaaagtgctagtacaggcatgagccaccatgcccagcctgggtctttttctgataacttccatgtctctacttaacatgtccaatctttcttctggcttcttgaacagatagaatccagttgtagtaaacgttttaatgtccgtgtctaattctatcattcctgtcatttctgggttcattttcattgatttttctccatgtcgaaaatcatatttttctgcttccctgcatgcctgataagtttcaattggatgccaaacataaattttaccttgtcagatgctggatatttttatattcctataaatacttttgagctttgttctgggatgcagttaggttacttagaaactgttgaatgcttttgagtcttgctttcagccttgccagttgggatcagagcagtgtttggtccaggagaaatttttcccactactgaggcaaacccttctgagtattctacccaatgccccatgaattgtgaggttctgcaattctggcaggtgggaacaggaactattcccagctccattatgagctctgaagcttgttgcttctgatcttttccagtggttctctctcagccctgggtagtttccttacacccatgtgctcatcagttctcaggtggccactcaaggggaactgtgagcaaacctccagagcgctcccagcacaactttctttttctgggagttctgctctgccaattccagccacattagcctccgctgacttgcagctccatctccccagctcagagagaccacgggcctccacctgggttttcccttcttggaaactctatcctggggcaatcatacagctcaccatctgtttctcctcttgcaaggatcactgtccatgcctaaggcccaatgtcttggaaacctagttttcaaactgtttcagctgggagggtaaatccagaccttgttactcagtcttggccagaagtgaaaattccactgcattggttcatttgtaatttttccagagcatgggctaacagcagctgaatgtaaaataccaaacacaagcaaatgcagcaagcctggtatgagtacagttctgctcagaatgccctatcttcttcctcttcctcagtttggttacatgttctattttgggagaactaattttgcaattcctgccaatttttatgcattttgcccttgtttccataattcagcacctccatcatctcttcatcacctccatcaagatactttcacttccttttaaaagcaaagatctctatttaatgtaatgcttctcagtttattatttacatttttattttttcaccatgctatcatttttactgggattgtcactgctttggttaatgctctggttacaaagtggcattgctgtggggcagtcagctgtaaccctacttcttcccataagctctctgattttagtgcacaggtttgcataactcatggcctttcaagaaagcattatcacatgatggcagaaacacttgtctatattcttttcacagataacatcctatgcacactcttctgcacttcgttttcctcatttagctatataccttggaaagaacttgctaagtcaatatatagaaagagcttcttcattctttttcatagatgcctattattgcattgaatgatgtgctataaatgattgagccagttccttactgggggccatttggcctgtttctactcttttgcaactgcctccgaaatggtcatgaaaacccctatatgtatattattttttataagtatatctgaagggcaaatttccaaaaagtaggagttggggtcaaggggcaagtctatatttaaatttggtagatatcttcaagttaccctccatagggattctacccatttacactccccccagcagtgtctgggagtagtacctgttttcacaaaaactcatcgacccagtgtcatcttacggttgaagtttttgccaatctgatgcgtgaagaaatggtgtctcagggcagtagtaatttctaagtcttgtcccacaagtgaggttgagcatcttttcagacccttgactgatttgtatttcctttcctgtgaaccaggagatttgacttttaaaagtttgcaaaagaaaagcaattaagtactaggcataccaatatttaagcatatcataaagcttcaataatcaaagcaacatgcttctagtgtgaatacactcaccgatcaatagaggagaacaaatggtctcagagagagacccacacatttagtacgtggagaaggtgatgtcttgagtcagtgggaaaatatgaactattgaatgaatggcattggaacagctagttagccatctggagaaaagtatccattcctactaccagaaaacaaatccaaatggattgacggtttaaatgttaaaaataaaaccataaaaatactagaacgagaataagcacaattttttataaccttggagtggaaaaggcttttctaaccaggactcagaaatccaaaatccataaatgaaaagattgacaggttcaactacagaattttttttttcttttttggcacggcaaagaacaccagaagtcaaaacaacaaaacaaatgacaaaaaacaagcaaacaaacaaaaaaaaagaaaacaaaatgacaaactgaaaagaaatatttacatctgaaatcacaaagaaatgttactttttcaaaaatgattctactagtctatggattgaacctgctccaggatgtggttcttctcaatcaggatttcagactcaaatagtacagggccgagcagtaatgtaaaagagagacatgagctagatatagggttatagggagtggtgggaactgtagcaaattagagactaaaccccccaccaacgctggggatagtggggtgttacttggcttcagcccattgctgcccctctagaatggatcccaaggagaccacatctttccatttttcaaagtgatccctaaaactctatttaatgtgaaatctccttattctttttcaatatggacaattgatatacactctctttgaaacaccttgtgaagcatacaaacacgtataaggctggcttcatgcccacatcttgcagtcttgctccatattttaactgaaccacaggtcccgagatgtctagatggggcaaatcacaagctaagtggtgacttggggaaccacacagatcacctcctttgggttcccccacctctggcttatttcatcagtgaggtatgtttcagagaacttgagtgataggtgtggccatagttgagagtggagcccagtggcctcctcatggtgaaatggagtcatttccctatttctctccggtgatggcatctttcaggctgtcccagcccagccagttttgagcagtctaaatcttcctgatctcactgcatcggtcaagacaggagccagtcttggcatcctatgggttgttggactgaggccgagttccctaatgtgaatcagcaactcttctgcacacaatgaagtgggtgaagtttccccatgcatgtcagcattctcgcccctgtgcaacacctccagcctggggggtcactctcccctccccttcatgtgtgctggcaggcttgctgccttttgcttgagctaaagtcttctgaatttagaacgtatagagtttaaatggagggtctttcctctagttacataacaagttagatttggtcacccctatctccaaaagccactggaggtaacaggcggaaacagctggagagattgagaatgagtttgggatcaggagggagtttagttcaacagcaatttgctaaggcagtgctgtccaacagacccttctgtgatgatggaaatcctctgagtggctgtgcaacgtgatagcccctagccacaggtggctactgagcactgaaatgtggttagtgcaactgaggaattgaatttttaattttgtttaattttaattaattgtaaatgcacctactctattgggcagcacaggtctaagcaatgtttcaaagctaactcttaagttgtgttatggactgaattgtttcccgcccctaaaattcatatgttgaagctgttacctccaatgtgatgggttttggtgatgaggcctttgggaggtgttagggttaaatgaggtcatgagggtggggtcttcagaatgggattgctgttcttataaaaagaaagagagagagagatctcgacctccttgtctctccctgaatgcacatactgaggacaggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagacagtaggtttttcctagacatgcaaaagcagaaatggaaaagctaatatcctgagcattttgtttgtttctcttttgaagatgcttcaccttcttctcttcttgcccccactatcagacggattttcaaagcaaagcaggtctacgtgtggcatcaggagctggtgagtgacagaagctggtgccttcatatagccgtcatcccagtagatattaagggagcatctcctctgtgccaggcactgtgccaggtgctgagaaagcagaggtgagcaagacaaatacagtccctgcccccctggagttcacaccagggatgagagatggacaataatccaatgatggcacaacacatgtaaaattgtacctgtaaagctctaggacacagggccaagacagagtctgcaactgtctggctccaagcctgtgctcttcactctgccactggtcacagatccagatgcctcatgagccagcccacaaggtcagtgtgtgaagatggctgggtggccctgtggcaaactaaggagccccagccctatataccggggtagccccaccccattaaagctggttattgcgatgccatagattattcaaaatttaaattaaaaaaaaacaaatgccagaaatcttttataagaaatttcccaattaaaaagacttaaattggtagcaacaaatttttaaaataaaataaaacttactgtgcaagccaaagcacatgtacagattggattcagcccacaggctgccattttgctaactgtgttctctatcatgaccatggagagaactgatgtgaaggcaggggactctgagctcagaaggggaagaaatgggggttagcatattcaggacagggtgtaagaaggcagaagggccacaggttatggatgtgtcctgtctcagccacatcagctggaagaataatgatggcgtggtttctagaattaagagttgaagttgaacaagggctcagcccatagaaggagcttatcgaagacatgctgtggcaactttgcctggccaccctgtagctcgccagttactttgatgggcagccatggcttttatccatattttcagggcagaagacaggtggaaccagaatgatgccataatggttgtaaccagtgggtggccaatttggggttgacataactgtatctgcaggggaagcatgatcaggtccttcttcatatttaaggcttacctactccttttaccccttcctctataagtagcactgctgtctcttacatccttttcctcatacctcccattcattctgtctacaaggttactaacttccttattctctatacttaacacatctttacattttgcccatatcacccaagctccttgcctactcactaagtttttataacacttcttccaagtttcattcaccccatctctttttcttttttctacaacacataattgaacatcgttaaatattcaattaagaattattgaacacagtacagttacaattgaacatattacaatagcattcttacaaagttctatgtatgttaaagccctgaaaaaaaattctgcttgtaaaatggactgatgtgttggaacagaggtgagcaaactttctgtaaaagagccagagagtaaatattttagattttgagggtcataggtctctgtcccaattactcgtaactctgtcattgtagattgaaaacagccatagtcaatacgacaacgaatgggcaaggctgtcttccaagacagtgttatttacaaaagcaggtggtgggttggatttggctgagctctgtgttctagggtcatattattaaaaccagatcttatctgcctgaatgtttggttggatatttgaaagtcaggtgggacctgggaatggtcttccttttgctggactctccacacattgcagaatgtctgcacctctgtcacctgcccactaaatgccactagttcctccaataaaagtgtccccatgaatttccaggcaccccctaggggtactgcagccacccaaccactggtttacacagtggcaggttcaggcatggggagaggtggctgtggtgtaggaatgaacatctgtcattcactcagcaaacattcaccagcgtaggctctgttgcaggcagcatgctaagcatgggccacacagccccaggctgacagtcaagccacaccttcatggaatttatatcccagggaggatacaggcggtgcatgagtctagttaacctgccataacaaaataccatggtcttggtggcctagacaacagaactttattttctcacagctctgggagctagaagtcccagatggaggtgccagcagattctcttccttgtgagggcttgcttgtatatgctcgctctgtgaacacatggcctctcctctttgggttcacagagagagaaatctccggtgtctcctttttttgaaagacagggtcttgctctatagcccagactgtagtgcagtggtgcaatcgtagtcactataacctcgaatgcctggactcaagcgatcctctcgtctcagcctcctgagtagctgagactacaggtgcacaccaggctgctgctgcttataaagacaccagttattaccttgtaactcttatgacctcatttaatcttcattactactctggaggccctgtttccaaatacagtcacaattgggggttacagcttcaacataacgaatctgggggccacaattcagttgcaacacgcagtgggtaaggaaatgagcaaatgacaagatgatgtcaactgtgatgagtgctccaaggagaataaacagggagatgtaacaaagagaaaccaggaaggacgccaggctctctgaggaagtgacagtggagctggcacttgcaaattcggaagagccagccatgggtcacaagtgtcgccagcagataggaggccaagtggctgaggagccaaggggagaggggtggggaatgagttggccggtgctcaggcaccgggaagccatggggttctaaaacagggcaggtgatctggtttgcatctcagaaagaccagttgactgctgggatgagtggactatggggggatggcaagggctgcaaggaggccaggagggagttctgtcctgagacagtgcctgacctgtccctagctctcccttcccctccgcttctctaggtcagacacagtgaagccagtattcacaagtgtacctgtgacaatgcctgccagatctcagtgaccccattcagaaaattctagaattattacaacttatccttttactcccagaggaatgaaggcccagagcacggctttgatgacgttgcttttgtgtcacttgtttcttatttcatttgtttatcatttttatttctgacgtttcgatgaaatgagaactgggcccacaaccagggtctgcacctgcacaatttgttgaaaagtcatagatgaaatctctctgccatctgatcattggcaggggcaggggtgggggaaggggagtggaatgagaaaaaggaaaaaaaatgcaccaaattttaaaaaccagtacaaacacacaaaaaatgcagagtcctatccaaggaacaagtccctgccctgctaattccttagagataaaaggagagcagcctgctcccagcccaggcagcccagccttctgttcaggaattgaaaggggtaattaaggggtaggggaaatacagcctcaggcagggagccatttattagagaggcacagacagacacacagaccctgcaactcctcagttcagagaggaggcacagccaggacagaagccaggctgtgggatgctcagtatgtacccttaaagcaaaccagatttttgctgctcctaaaagttcaggtggtaaagcggggaccagagtccagattccacccacctttgagttatgtgcttctttccctgggcccggggaacatgcagggaattcctgatttttgtattatttcccattcagtagctttacacatgtcccaggaaggcagcttagccccctagtcctgaatccacctgccttcttacactgctttttatttttcatacatttattttaaaccacatcagtgctattagtgtgtatctttccagaacattctctatgtatgcatttacgagcttatttttcttctcaccagtagaaaatcctgtttttttaaacacaagtaatatcttggtgtgcatcttgttttataagttgtcttttatatttttcgccaattaacatgtctcggagatctctcaaagtcggttcaaacaaacccactttagtctcttgtttggcctctgcagacgctgcagtactgcatcgagaaagccagatgctggggttgaatctccgcctctgcactcactggctgtgagacttgattttctcatctgtgaaatggggtttataggagtagcttttgtgaagcctgggacaaagtcaagtgcttccttgctttggctatcatggttagtgttatggatataccacggcatttagccattccccttgaaatggacaaaacttcccacatttcactgttttcacagagaagcctgcaatcttgaattttggttgctgcagccatttgctgtccccgtatgtgtctccctttgtggcaaccagggcccccttccaattcccgcagcaggcctcgccaggtctcgccacactttgcatctctgctactccagccctaaactgcagcctgtaagaactggcagctcaaaaagattgtgcaacccccaagaccatagctcagggccatcccagctgctgctgcaggtgagccctagccggctgcctgacctttaggtcagtggagtatttttgatcgcttaggagcaagagaagagagccaagaggaggcaaataccgaagcctactagagacaacccaggatcccagaagtgtatttctagaaggggtgatagagatcatctaggtcaggggtcagtccaaataggaaaaacttcaggctttgcaggctatacagtctctgttgcaactgctcaactctgccaatgcactgtgaacattgttatagatgacacataaacaaatggcatggctgtgttccaataaaactttatttacaaaaacaggtgaccagcccacagaccatagtttgccaactcctgatatgagttggtctaagtcaatccatcccggggcctgggtgagttgctatggctgcctttagtgctgttcctgacactgaatcatacacaatgacccagagtggcaggactgtatttcttgcccttcttgcaggcaaggtgtcggggagaggcagtcagctaattctagccactgaactgagagtggaaatgatcatgtcatgcctaggccagagcattcaatggccaatacaagactctgccagtgttcaaattgaaggctgctcctttaactggtgcccttgagtgactccagtgaacatagtccctgatgattctcaatggacatatagcatgaaagatagatcaactttgattgcattcaagccagtgggatattggggatgtttgttaccacatcataccataacctctcctgactaatttattggcacaagagattattttacatggaacatgaaagtggcactcaaagtcattgggtcacatagtgaggaagtcattcccctttctgtcatctttcagcccttctgattcagtgataaagggaggaaggaagtctctatttgatgctgatatatcttcaatgtgtctctaatccctgcaaatacttctttttaacaagatgagagcaaaccctaggtttaaggtctttggcagacaacagtatttggctagaattaaaaacatttgttccctatgtattttttgtgttttgtatttatcattaatggcaagtggtattgattttctatttacagtaataatataaagtcttctcagacaaatttatttaagtaaaaacagtgaatgattatacggatagggcttaggacacaggtaagtttcgcaaaaatgtgagtcaacattaagctgatataagggaaatattaaataaaagaataggccaggtagtttgaggatatttaaaaactgtgtgggggcagggagatgagtagagtctggatgcaggaatcttgttcaatatcttccttgcataagtgtgcaagtggaggcttagagaggggatgtgctttgctgtgggtgaaccagcttcccaggaccaaggcgaggagggatccccaactttgcaattcagaggccaggctatccttgtgcccgaggccctgtccccaccaaagttaaaaggaaaactgaggaatgccagtaagtcaacagaattgcctggatgtgtttcctaagactgtcataacaaagcaccacaatctgggtcactttgaagaatataagtttattgtctcacagttctggaggatagaagtctgaaatcaaggcattggcaaggttggtaccttctggaagctcagagggagactgtcccatgcctctctcctggcttctggtggtggcaggcattccttggcaatccttggcctatagatgcttcacaccaatctctgcccccatcaccacatggcattctctctgtgtgtctgggtccaaatttccttcttcttatgaagacaccctaatccattatgacctcatcttaatttgattacatctgcaaaagacactgtttccaaataagatcacatttacagctactgggccttaggagatgaacatagcctttcaagggacgcaactctacccacgacatcacccaaccagggtccctggctgagctgcaagaggcttggagccaagaactgcgtcctgtccctgagctggctgggcttagcaaaaattgaaaccaccctagtgaaagaggtcggtcaaggatcctgctgctcagctggcttgtattagtctcagtctgagacggtggcggcaaagatggtctaggccccagcaagtgaggcagcaagaggccaatgccagcaaaggtcagggctccctctttaagtataaatagaaccttcttcccagccaccccctcccatagccacacaatatctctttcaaagatctcaaaacactgaagcagaccgtaccaaattgactttattgttttaaaaccagccccttctgtctgccaccacccgccaccccttcccgaaggggaagaaaaaaatcataatagatgtctctccagcgtgcacctctgttctcctctctctaatggcagcttgggaccctgaggcagtgacgcttagtaatgtatcctaatagtcagtgtttgtctgacaaatacctagtgaccacaagcctaatcagggccgccatgaattaatggtcagtgtagtgatgggtgctgaatgatcataaaaatagctaatactgggccgggcttggtggctgatacctgtaactttgggaaacggaggcaggaggactccttgagactagaagttcgagaccagcctgagcaacatggcaaaaccccgtctctgaaaaaaaaaaagaaaaagggggccatgtgtggtggcgtgcacctgtggtcttagctacttgggaggctgaggtgggagaatcacttgagcctgggcagtcgaggctgcagtgagctgtgattgtgccactgcactccagcctgggtgacagagtaagaccctatttcaaaagaaagaaaaaacaatgctcacgctgaatgagggcttctggggaccacggaccaggctgagcacttggccagtattcactcccttggtcaccacttcagtgtttgcagcaagttgttgccatttgacagatgagaaaactgagactccaagggaggaagcgagaaagctgggaggtggcgtaaccgggatcagggccgggactagcatgaagtaagagaggcactggctccatgtgcaaaatgtaacagagtgccaggaaattcaatcatggataactattttaaggcactatttaaaatagccaaagttcgcgcaaaaactccctgatgaacaaagtatcaaattttgaaataaagacagactcctgctgtttgtttagtgacccagcaatattgtggaacaggaatggtcgtttccaatcagcccagggttctggtgcacacgggcattatggtcctgccgtggcagggctaggagggtaagcagacagatttggcaatacagggactgttataaagtcatgcttcttgataatagtgtttttaacttcttccacttgcttcgtaatattggaggatattttgggaaatgcatataagagcatgtatttttccttttgcctcaggcttcagtacagcttggttcagtgccaatcaggacacttctccaggcagccggaatccaaagttcttgctttatttatttccttccttccagtaggttctacagttttgcacacaccacctatgtcacctgcataaccaagtacaggggttcagaatgtggccactgaactcagatcgcctaaattcaaatcccagttctgccagttatcaactatgtgacaggcaaggggctttgtttttctggacctctgtttccacattggtaagatacaaatgatgggtgtattagtttgttttcacactgctataaataactgaccgagactgggtaatgtataaaggaaagagtttttattgactcatagtttaacatggctggggaggcttcaggaaacttacaatgatggtggaaggtaaaggggaagcaaagcaccttcttcataaggtggcaggaaggagaagtgccaagagaagcaaggaggagccctttataaaaccatcagatctcatgagaactcgctcactatcatgagaacagtatgggggaaaccacccccatggctcaattacctcctccaagtctctcccttgacacctggggattatggggattgaggattataattcaagatgagatttgggtggggacacaaagcctaaccatatcagtgggaattcccctactcatcagcaggttgttgtagtgattaaatgagtcaaaactcatgcaacactgagaatagacatggcgcaaaagaagcactccgtgttcattggcattattacgtgttgcattgttatgtgttgcattgtattattagttttccatgacttctataacaaattaccacaaacttcgtggcttaaaacaacatgaatttgttatcttaccattttggatgtcagaagtcttactgggctaaaatcaaggcatcagcagagcttctggagcctctaggggagcatctgttcccttgccttttccaacctcccaaggctgccactagtccttggcttgtagacccttcctcaagccagctacagtgggttgatcttctgtagtcccatctctctgactctttctgctgcctttctctgccacttttgaggaccctggtgattaaattaggccctctcaggtaatccaggatcacctcccgatcttaagctcagctgcttagcaaccttaattccatctgaaaccctaatttccctttgccacacatgtaacctaaatatccacaagtcctgggattcgtattggatatcttggtgggtaggggcatttgttctctctaccacacgtgttcatcattcaacaagtatttattcacagcatctgctgtgcagcagaattaggatttacagcagtgacaaaacagataaaaactgcccttgcagggtttacattctaacagggagaggtagatgtatatatatttttaattttaagtaaaattcatagtgtttctgatggtgatggattcatgtagaaaaaataatagagcaagggagagaattaggaagctgatgattttaggtaggggtggggcggtcagggaaaaaagtcaactactggctgggctcagtggctcatacctgtaatcccagcactttgggagaccaagctgggaggatcacttgaacccaggagttcgagaccagcctgggcaacatggcaagaccccgtctctacaaaaattagccaggcatggtggcatgtacctatagtcccagctactcaggaggctaaggtgggaggattgcttgagcccaggagattgaggctgcaatgaactgtaatcgcaccatggcactccagcctgggtgatagagtgagaccttgtctcaaataaataaaaatataaatataaactactgcttctgcccacaagggtgctctggggacaggtccacatagggcagaggaaaccctgaggggtctgtgtgtgtgtgtgcacgcacacatacacaatgttcattgtgatataaaatttaccatcttaaccatttttaattatacagtaaggagtgtgaactgtatgcaccactttgtgcaacagatttctggaacttttccatcttgccaaactgaaactatatccattgaacaactagtccccgttccccgcacgtagcccctggcagccaccgaggacttcctgtttctaagagtgtgagtactttagatacctcacgtaagtggaatcgtacagtatttgtctcctgaggggcttttgtgaagagagtaggggcttctcgaacaggagaaaaacaaacaaaaaaacattgatctttttcacagctactgggccttaggagatgaacttagccttttaggggatgcaactctacccacgacatcacccagcctgggtccctggctgagccgcaagaggcttggggccaagaactgtgtcctgtccctgaaatggctgggcttagcaaaaaaccagagcagatgtcgaaatcacacacacacacacacacacgcgcgcacaattctataatgtgagtttctaactattttgacctagaccaggtgtaggctaactaaaaccctcaggccaaatctgcctgctgtctgtttttgtaccacccatgagcttaaaatgggttttacattttcagatggttgaggaaaagaatcaaaagaagaataatatttcatggcacatgaaaatgatatgaaattcaaatttcagtgtctactaataaagttttattggcacacggccacatccattcattatgtctattgtctgtggctactttcctatcacaaaggcagaactgggtcattgcaaccagagaccatgtggccaaagtagaaaatatttaccgtctgtccctttacagaaaatgttttcccgtcccctgatctagacccacagaaagaaatgcgttttatattttaaccctgagctggcacttgggcatgcatatacctacaatggaaacaaagtatcaacaaaatcacaccctcactgcctgagatcagtgcagtattctcaattctcttttttctattcctgaggcggggcatcttgtagtgataaaagacacagattgtggagccagcctgcctgggttcaaatcctggttttgctgttaactgtgtgactgtgggatattttttcgtttctctgtttcccagcttcttcatctcatagggtcattgtgaagatcaaatactttttttttttttttttttttttgagatggagtcttgctccgtcacccaggctggagtgcaatggtgcgatctcagctcactgcaacctccgcctcccaggttcaagcggttctcctgcctcagcctcccgagtagctgggattacaggcgcccgccaccacacccagctaatttttgtgtttttagtagagacggggtttcaccatgttggccaggctggtctcgaactcctgacctcaggtgacccacccacctcggccacccaaagtgctgggattacaggcatgagccaccgcacctggcaaagatcaaatacttaatagaggcaatgtttagccatgcttggtgagactgcacccagtaagtgtttgccattttaagcacagaaggccatcttttctacagtattggttctatctgctaaattcatttcatacacactagcaggtcttacccagtttgcaaatactgttccataaagaagtgggaacggtcttggcagtctttgaagaatggtatgttccacttagagcctgtctccgtatctccctcaatgggggatcttgggcaagctccttccacagtctgagcctcagttttctggtctgtcgaaggggaattgctgtacctctcctgtaaagccaaactgaggactagtgagaaaacgccgagttggggctcagcacggggccagccctcagggacattcagcactgttttcattatttcctgttctgttacacgctctgctgttacacaaggaaaataacaaccatacagcagcaactgttctaatcacatcacacgcatagctcctttaatcacagccacacaacaggtagggactgaaacacagagacatcaagcaagttgcttgaggtcacacaggtaagaagcttgggtctcagctcagcctttctggctgaaagtcaatgctgttatcactgtaactacactagaacttgtcttgaactgtccctagaaatgggagtgtctgggggttaggggggaggttaaaaaaccaaaacctgtaaaccactgtgacttagggcttatgtagccagcatcttatcactggacagcacatgttctgagggcatgccaagggtttcacagaacacgtgaggctccactgtgtgctcacagctgcagggggccagaagcaccctgtggggtcccagcaggtaaggagcttaggcctggctggaggataaaccaccctccacagggaagttagataaccagcaggtgggtgcagcccccaggtccctgctcctcctgccagcccgctgaagcagtcccgcccctgcgagttagaattctacagaaaaatctgatttctgttctctagtgtttaaagaaccctctgatcctaaggaaatctaaaaactttggcaactggcaactccaacctgccagaaaagcctccctccccatgctctttcctttaatttatcttatgttattttgaatagtgaatacctgcacatagtacagaggtagcagttaagtctgcctcccacttttaacccatagccatccagatctcttccccagaagcagcccccatcaccagtttcttctgtgtccttcaagagatagtctgtgcacgactaagcatacatgtatattgaacacttttatacagatggtaaaaacctaaccctaaacctaccaggactcataagcttgtagcaactgccaacggtctgttctggtctgctctttttatcactgagttgcagtgccaggttctgaattctgtctgagagaactggaccaatcaaggaagccactggcaaatttcattcaatgaacatcttgttggactcggtaggaaggtgtgcagggatcaattagtgatgcctgccatgaccacgggaggggagttttaggataggtgctcagattgttctccctcagtctagtaaatgtttcctgtactttgaatatattatacatggctttgtcacatcaaaattccacctccactattatttgattttttttttaatttacagacttcttttggttcaaaagtaaattcattttaaaagccaaatttatagcactaccttaaatggaaagccagttttgtttgccataaatggaaggtttggtaagaataaattcactaaaaataaaattataaaataaatataaaataaaattggtaagaatatattcactaaaagttaaattatagccaagtatccaaatctgaagacacaaagagattagcgagtgtgaaagatgttctccttaacccaggaataattaatactaatgtaatactcagttccaggtgctccctcattaattgcttacaactaccatataaagtagaaattattatcacgtctattttatagaggaggaaactgaggcatggcaagggtcagtgataggtgcaatgtcactcagctaatgagtggtaaagccaggagttggacccaagccgtctaactccagactccaagctcttcacttctgagctaggctgcctattagatcgattaaaagaaattaaaagggaagtcatctaaaattatcttttgtatcatcactggtggtttctgtcacactttggcagccctagattggtagaaagagccaaactggacttaaggcttaagtctgggttctaaccctgtctttgttacaaattcatatatgaccctggtcattcagcctctgaccctccacttccccatctgtgaagtacaggagttaggctgtatttgagcttccagatggcgggaaccatcccttatctcaaagaacccacagcacctggcacgcattatcagttagagttcattcagccaccagcaacagagaaccgagtgtcccagcttccctctgtcggtctaccctgctatacttggacttagctttttcatccttatgcctcttatcacctcatggtcacaagacagctgcttcacctccagccgtcacctccacattacaggaaggcagaagagaaaagcaagaaggagcaatgccacaatcaggaaagccgaagttttcaggttttgctttaatggctggatttgtgttatatggccactcttggctgcaagggagatagagaagtgatcatttttacctgggtacattgccgctccagttggattttcttaacaagaaaggagaggaagcagatattgagtaggcacccattaggcgactgtaaatacttaaagaaggaaaggcgagagggaggaaggggaggattaatccttcagaccccttccagctctatagagctgtgataaaagaatgttcatcctgctgtcttacagagctctgggcccaaaagtatgaatgttatatttttccttaaaagggtttttctgtgaacttctgcatgttgaggccacttttgtttttattggcaaacttattccaggggaatgagagttcatcacagtacagatgtatatttaagtaggacaggaggcacaggcaggggacccacggaaagggaatgttttaaaagggagaggccaacattcaggctgggaagagtacacaggagtctcaggaaggaggtgtcaggtgccttccaacacagccaaggactggaagtagccctgaagccagtcctgcttctccctggctgcccgtggtcatgggtgcaggccgcattcttttgtgaggcctctcagcatcctttctgcagtgctgtcttcagaaggtggtgtttatcctttcatttatgacctggcctaactttgcactttttcctgtcactttctagctgggtagccttggacaagtttcttaacctctctgttccacagtatctttgtctataaaatgggctgatgataatacgcatttcatagaactgttgtgaggattaaataagttaatacgtataaagctcacagaaactttcctgacacataataagttctcaatcttaccacaccatcatcattattgccattatcatcattgtcctgtctgagtgggtcaatagaagctgacaccttcccaatcaatgttgagcagtttttgagtagttctttcacttttttagtgatcaagaggatattgataggatatagatattgatagttcaacattacgaggtgtttggatccaaacaaagttgtccaggttgtccagtaatagactatccttttaaccacagacttaaatctgtgtttttggagacagggcactaggaaagtgttcatagggcatgctggtatggacaaagttggatactgttaatcagcacagcccttcccactggagctctgcttttgattttacacaactccagggggcaccattcacatcaaagtcatcatagactcagtcatcagaccattttcaacatatggcgttaaggtgtcttgagaaagtgagaggcctttttctagcggggctgctttccatatgctctggtccacccttccaagaaccacagatagcccatgaacccttcttagacttactcattcattcagcatatgttgggtgacacccactgtgtgccaggcattgttccaggcactagagatgcatctgtggacaaagtagacaacagtcaatactcacagtgagaaagacagacaaaaatcaatatttgtaatagaataaataagtacattgtattgtagggtgagaaacgctatgaatgaggaacaaagtagagtctttcgggggggtgggggcaatagcaagttgcactgttcaaccaggtggtcaggctgggtctcactaagaagttggcgttgagcacatggttcattcagcgatcacatttttgtagaacgctgttcattttttaattccttcactcagcaaacatttattgagggcatgccaagtgcttaactaacattctctcatttcatctcacaaaaatcctatctataattactgatatttctcccattttgtaaatgagaaatttgagtcacagggaggcagagtgacttgctcaaggtcatacaatcggagaacagcagaacctagttctaaatccaggactgagacactgccaaggaagcataaatacactgcttctcactgtactcatctagagagagaaaacaatactaaacagatcatcatgtacctaattacatcattgcaattgtggtaattgctatgaaggaagagtacaaggggctttgaggaactgtaactgggcctggggaaatactaagcccagtgtatggactggtgattgctgtgtaacaaaacaccccaaaatgcagtggcttaaaacagcaataatggatcatttctcgtaatgtcttggattggctgggctcagctaggtggttttccactcttcctggtgatacttggggccacacataacagctgcattcagctgagatgcccaagaaagctatccccattcatctggcagctggtgctactataggctggggcaccttggttctcttccacatggactctcttcctccagatatccaaccagcttcctcatagcatagtactgggttctaaggaaaagaaggtggaaactgccagctattttaaggcccggactcagaagtcccagaacatcatttctgccacatgctgttggtcagagcaagtcacaaggccagcccatattcaaggagaggggaagatgtgggaacagtatacacatacagggatcagaagagttcttgacagccatatttgaaggtcagcctaccacatcctgtccttaaaatgtctcacaagtttctagagtaactggagcacagtgcttccatggatttgttaccttgaagacgttctgcctgaagctgcccctgtcttcttcctcaactcttttcatatccgtctacatgagcaatggaattgctatggaaccaagagaacttttgtcaggaatttgcaggggcctgtttttgagaatttttttcagcatcaatggtatatgcgggtttgggagtagtgttagggtatatttccagcttctataacaaagatcaaaactaacaatggtttgatgaagtagcggtttatttctctcttatgtaacagttgggtgttacagaggaggagacccagactcttctcatcttgctgttccacaagtctgtgttgctgtcctcttctatacgacagctaacatcttaaggctaacgtctaagtccatttgggctgctataacaaacagaatatcatagactgggtagcttataaacaacagacatttacttctaacagttctagggactgggaagtccaagatcagggtgccagcatggtcaggttcaggtggggactctcttcctggttcatagaccactaactatctttttgttgtgtccttacatggcagaaagaagagagctttctggggcttcttttataaggggcttcttttataatcaccttcatgagggctcgactttcatgaccaaatcacctcccaaaggtctcacctccaaatactttcatgttaggaattagctttcaacatgtgaattttggagggacacagctaaaacttgtgagcttgatcactgtgagacagaaggaaagaatggacattgtgggcagttaccagcctctaccactcatggctagtgggggaaccagcatgtagatacaccgaaggatgaaggtgtctgcatctctcatcatctctgcacagagcagtgtcagctgtgggctgcccaccagaattcccagccctcatcctaaaacaacagccctcccttggtacaaacatccagtgagtgagctttgatgggaggcttgtgtaggggggtgggctgggtccaagccctcctagccaagcgtgtatggatttcatgctaatctgcctttctggactagtccattcatctattcaaaatgtgtcgccaggtggctgcgaccacgaagggtccaaactagggccagttctggaccaggtttgacactgtaaaatatgactgttaaggtgagttcaagagttcagcagcttggtgaactcttgtgtatctatctgggaagggttctgacagatctcagctgcctcatggaacaagcacaactcttactgcagacagcttaccacttagctgggcaaccttagacatgttacttaacttctttaagcttcaatgtccttatttttaagattgtcaggctggggtatgatatctgtctcccctgggttattgtgaagacaaaaataagatcagattagggcaacttgctcattttctaaaatgtatcgtgtacatttctcaaagaatgattttttttctcttttcaaagtttaaatgttgtagtgcatccccatgaatatccacttacgctgtaggatcctgaaggtcgggggctgtgtcttattcccctctgcatccctcagtgagtaattctgggcctgggagtgagcagttccccattaaacgtgggcatgcatgaatgagtgcgtggatgatctgagactcctaggcgaggggcagcaaacacaaatgcccacaggagtagggcaggtcacgcagaggagtaaagtgggctaagcctaagaaaaaagatgagcaggcactgctttattttttgtctctctctctcttttttttgagacaaagtctcactccgtcacccgggttggagtgcagtggcgcgatctcagctcactgcaacctccgcctcccgggttcaagcgattctcccacctcagcctcccaagtagccagaattacaggcatgtgccaccacgcctggctaatttttgtatttttagtagagacggggtttcaccatgttggccaggctggtcttgaacacctgacctcagataatccacctgcctcagcctcccaaagtgctgggatttcaggtgtgagccaccgcgcccagcctgtctctcatttttgttagggacaaggatattgtcttgtgtcccactggtgctgtaacaaagtgccacacagttaatagcttaaaacaaaacaaatttatgaccttatcgttctggaaattagaattccgaaatcaaggtgttggcagggctgcttccttctgcaggctccatgggaggattcattttccctgctgcccgcattccttggcttgtagcctctttctccatccatctcgctcccagcctcccaaagtgctaggattacaggcatgagccaccgcgcccctgcctccctcttagtaagacaattgtgattatattgggctcactgataatccaggatcatctgcccatctcaaggccattaacataatcacatctgaaaagtcccttttgctgtataaactaactcgacttattcacaaattccgaggattaggacatgaacacgtttgaagaaccattattccgcctaccacagatacacagaaacatttttaactgtaagaaagctatcaggccaaggatgatggcatttttccccagtattaaggagacctcagggaggggaggagagtgtggccacgtggagaacacatgctccatctaaaaggggctgctactcacttttagagtatggttattacatatgagaaactgggcctgatttgccagaacttcccccacttttttgttcaaagggaagcccaaaatctgggttttcatgggaaattattacattttgtcagtttcaaaaatattatgcaggccgggtgcagtggcccatacctgtaattctagcagtttgggagaccaaggcaggtggatcacaaggtcaggagtttgagaccagcgtggctaacatggtgaaaccctgtctctactaaaaatacaaaaattagctgggcgtggtggcatgcaccttttaatcacagctactcgggaggctgaggcaggagaattgcttgaacctgggaggcagaggttgcagtgagccaagatcacgccattgcatgccagtctgggcgacaagagtgaaactctgtctcaagaaaataaataataaaatactgtgcagcagttccctggcagatattatgaaatgtgccaggctgggaggctcaagactctataaattgctgaatctgtgtcccctgcttcactcccagcaagagagaagtaacagaggtgagagtaagaagaagaatgatactagtagtgggtgacatttgttccagcatttctgagttccaacacgttatggtactcaacacattaaatgtattaattcatgtggttctcacaatggccctggaagatgggtgctatttgaagacccattttgcagatggagaaactgaggcacagaggcactaagtcacttgcacagggtcacatagccagtaaatagcagattcaaactcagtcagtccctattctgtttctttttaactttctattttaaattaagtttagacttacagaaaagttgcaaagatagtacagagttccctgaagcccttctcccgctttccctaatgtgaacctcttacataaccatcgggcagtgatcagaactagaaaaatgacataggtgcagtgcttttaactaaactacagactttatttggattttaccagtttttccagaaacatccattttctgttgcaggatccagtcaagggtccctgatatggtttgggtgtgtgtcctctccacattgttggaggtggggcctggtgggaggtgtttggatcatgggggcgaatcccttgtgaatggcttggggctctcctcgtgataatgaatgagttctctctgttaattcacctgcagatctggttgtttcaaagagtctgggacctccccctttccctctctcttgctctgtctcgtcgtgtgacaccccctgctccatgttgtcatgtgacacacctgttccagcttcgccttccgccatgagtaaaagctccctgaggcccccccagaagctgagcagatgctggcaccatgcttgtacagcctgcaggaccatgagccaattcaacctctttgctttaaaaattacccagcttcaggtgtttctttatagcatgcaaaatctgatgacaaacacagtcccactttgcatgtagctgtgcctctctctctaggctcccatctgtgacagaccccccccccaccgccaccagtctgtctttctctcatgattttgacacttttgatgaatactagctggacattttggcagttgtccctcaatatgggcgtgtctcctgtttcctggtgattagcttgaggttgtgcacttttgtcaaggagatcacataagtgacgttgcaccctcagtgcatctttccaggggctgcacgatgctgatgtcttattattggtgatgttaaccttgatcatcatgctcgagtgcctcgtaagatcacaaatcctgtatctgtctgtcccaatggggcaaggagtctcgtagaaatctgcatggttctcaggtatgcctgccggagagcttggctttctctcttgttaactttgatcatcagagtctgggtcctaaccccttggtttaaatgctttctgtatgtagcgagagggaaaaatataaaacaaacacaaaatattcagcaggacacatcagcagacctcacccatcccttgggctgacctagtaaatacgtatgaagtgctcagtaacagtgaataacctccaaattttaagaaggcttaaaaacacccactagtgatggcaggagtgggaaagaaaagcacccacattcggggactttggaaataattcaagcaatgaagattggaagagatgatcagggaaggggaaataaatccagcagagatgaaagccaaggtccgcagctgctcggaccatcaaacctttataagcaatgtgaggtttttaaggaaaggagtgaattatagctgttaggaccaaggacaaaaaggctttgatctaaaagtgggagacatcttaaaggaagctgtggcttttgcataaggtatttccacatcctcctggggtgcattagatgaacccatttggaatttacaggtctgcagaagggcccttattcctaagggtatacacttgaaacaagcggctttgcaggagtggagttgatatttggagagagaaagcgtagcgctccagcaggcatacctgagaaccttgcagcgttttacgaggctccttgccccgctgggacagacagatacaggatgtgtgatcttacgaggcattcgagcattgccatgggaggtcattttggtgagcccttgacctctccatttgaaaagtatcagtttggaaaaggttgtctttactgccaggaaactttagaacagaggctataacatggctttttggacagtcactctgtcgctaaccagatgttggcctctgtttgccctggggcgagaccctagcctatgccggactttccctctcgttgagcactggctgccaaggactcatcacagcacgttctgcatcgcttcgccattgcagtgtatgcacggtgcacgtggctggcatcgcagaacgccatcaaaacagccccataggcggccatctgctgtgaagaaatcagaagtatgtgcaccacatacatctaggtgcattgggaggaagaagtaggggggcggatttttagctgggttaagtcaaatacccaccgaaactatgaatgaaccttccagtaggaccaaaaattacagcagattggaaatgggagaaaactgagatgaagaacaagcccccgaggcagacactcctgggttctaatcccagttttgctcataatctgtgagttttaatttgcaagttgcttaacctcaaggatgaaagcttcagtttctcacctcctgcaagtctgtcctcagatgtggagccttctctgatgacccaacccggaccccagtgttcctgggtccccttccagcttagctggctccagcacctatgaccatgggacacattattttatatatttatgcaccctcagcccctcctgactcatgtcagctccacagaggcagggatttcatcagtatcctgcttaggacagactggcacacagtaggtgctcaggaaacatcagtgaaacgattgaaaggagtcaccgaccttgctctgttgttttcctttttggcagaggataagctaggataaccacagctcggggctcagcatagtgcccggcacagagcagatgcccagcaatcagtaactattgctaatgtcaactcattcacttttttcattcaatgaatagttatcaaacgtttgttgtgtgccaggttccagctggaaatagtgccgagaacaaaacagatactcctttttttccccccagaaattatttcttgagagcctaccacgtgcctcccactctcccatgaacaaaagacagcctctgctcccatggggctcatattccagtgggaatgtgataaacaataaaagcaaccctgaagaaatgagatgatttcagaggcgtgctactaaaagaaaaagctttagaaccagggtcatgtgcaaggtgtggctggagttggggggagcatgggggctgctttagctggagtggtcaggggaggtcacatgtgagctgagacccaaatgaggaggaggaggagaagccagcatgggaggggctggggcccccacctgtggtcctggcagcatcagcatcacgaggggcgtgttagaaatctcaggcctcatccagaaccttcagagtctgtgaacggattgctcagctactgctgggcatttaccccaagccgacctttgttactaaggaatgtttggggcttgagagtgccagtcctctgctgagatttgcagtgcccttttgtaaaccgctacaaggcaaaataggtcgttttaggagtcctgcttctttctttttatcttttttctttttttgagacagggtctcattctgttgcccaaactggagtgcagtggtgtgatcacagctcactgcagccttgacctctgggttcaagcaatcctcctgcctcagcccccaagtagctgggactgtcaccatacacgtgtcaccatacccggttattattctgtattttgtagagatgggatctcactatgttgcccaggctgatctcaaactcctggcctcaagcaatcctcctgtctcagcctcccaaacgggcttctatttcttttatccacattcacagtataagactgagacatgaaatatttccagccaccatctgggtaggacctggtgtcattgagtgtgtcccctatgtggtcctggaagtcaaggactgtgtctgggtcatcttcgtctccccagcccttaacctattgcctgtggagggcatagaattggccaccctccatggtgggccttacgtagtttctcgacctttttttcattattgtcccccacccccactcccacctcaaggatcctttttagacattttttcttctagatgaaattacaaagaataagggagaatggaaattggaggccacccagatctctctctctccacccttagagcccttattggttttgcaagtttctcagcaagaaagacttctttatgaaaagcgaatgccacggacatgctgtacatctgtttatgtgctgaaggtgtatctctacttcattcataaaaagagtaacattcggccgggtgcagcggctcatgcctgtaatcccagcactttgggaaaccaagatgagcagattgcttgaacccaggagttctcgaccagcctgggcaacatgacaaaactccgtctctactagaaatacaaaaaattagccgggtgtggtggcgcatgcctgtagtctcggctactcaggaggctgaggtgggagaaacaaccgagcccaggaagtcaagactgcagtgagctgagatcatgccactgcactccagcctgggggacaggagtgagaccttgtctcaaaaaaaaaaaaaaaaaaagagtaagattcttctatctcccaagaaccaatcatcacccaaggaggtgaatattggttcttgggagatagaagaatcttacttgcttacaggcagtctcaagggtgggggtgatattgcccccttgagaatacgtgggctaaaatttccacaaaggaggggctcagggttgtcaaggagaggcagtcaggttaggatccgagtagagtcgttagggtcatagactcaaggcggactgctgcagtcagcatcccagctcggaaccttactgagtgaccttgggcctcagtttccccatttgtaaaatggggatggtattgatgatgacactcaccttataatgtggtcatgaggattaaattaattaatacaattaactttcttagagaagtacctgtcacacagtaagaatttgataagtataagtgattattgtaattatgtttgagaaaacctaagttgtctgtaagacagaatggacggggtttgttcatggagattgtgaggcactgagcattgcaccccccacttctccaacttgaccctgatgccacccctggctgaggtgttcagtgaatatttgtggaataaatggcatctcattcacatctctgtctccactttgaatgaatgaatgacgctaaggaaatagatcacgtctcattcatcgcagtttcccctgaaattcatatactgtcagcgtagggctggtgatgaaaaaatatttgtcgaattcatgaatccgtcagtttcactgattccgttcagcagatcagcactgaatgtctaccctgcaccaggtgtttctgagcatgtgtggggggctgcttgagataagcaaggtgtactgagtaaaagcctcctcccctctcagatcctcttcactaatgcggatagacagaaaatgagcacattcacccctctttgcccagcacccaacacttgacacctgggcagcccaggacttgaccccaggacatcccatacagagttctttctgctgctctgccccacgtccctcagatgtgtgactccgggactcacttgggggacatgcagccagtctcctagctatgccaggccctgcttctgtctctctcttgctgttacctatgaacttttgattcagtttggactctcgcacacaagtaaaataaaacccagcctaaactgacttaatatttttacaggaatttattgtaaactgcagctattacgggctccagaaatagatggatccggagctcaaacatgtcagccagatttggttcctctttctgtctctctttttctgtgttctgcagctgtgctttgacagactgtgccctcgtggtggcgaagaggctgcagcagctccagcctctttaccatatgtcatcttgagattccctctcattggacctgcctgttagttcaggtgcacacccctaaagcagtcattgtggtcaggggactgtgatgcactgattggtccaggctcagtcacgtgatgcatccctgccaaattctcaccagggaagtgtaagccatctcgaacctcattgccctgcatgggactgtatcagtgaaaatctctctctgacgtgtataacttgtttcagaaactctggtctttatgggttaccattcccgaggagatcctctgcaggaagaataggtatttggtcttgggatccgctgtgatcccctgatctgtttccaccacactgggtgaaggcagatggtctgtccctccctatattgtatcagatcatgtcactcccctgtttaaaagcctttgtctctggagattcccactgaaatcagaaataaaccccaatgccttgctgcgaccgccttacctgggcccagcaccgtgcagttcctgatgacctctctgacctcctctcgcacacttgcccccttatcctctcctgaatttcactcgctcttgcttctttcagatccttacccctcagggtctttgcactttgctctttcccgtaacctagaatgttctgtccccacgtcttcatgatgtaactggctccttcctatgcatttagcaaatgccacctcctctaagaggtcttccaaatgtattgatcccctgtttaactgaaatcaacaaacataaatattcagtccagcatgtgctcagagtagccccactgtcctgcaactcaccttttttttcaccccgcactgcattttggacatctctccacaccagcacatgtggaccgacatgtgacagctttctcctctgcagcaggatggctcttcccgcccctgctgcccccgccacccctgctccttccatggcattatcccgacttgtgtggcagagacacagtgacagggcagcctatctgaaatggcgttctcaggcatgcggattgttttattaccagttaaatatgctttatgctacctgtgaatgaggccattgtgacatttagcaactgatttgattaaacacagatgtgggctagactccacgtggagcaaagatgcaggaagacaggctccgggtgtgggtttggagtttttaagacggtgagaaggacttgacgactcacagcagcaaggcagatgtggaccaggcgtcctgttggtctcagagctgagaacgcaacatgggtaccccaggaggctttgtctgctttgggttctgctgtttggtcctatccaaattgtttttttttttttaaccttccctggatgtttttattcctgtgaatttttttaaatgacaaattggtgaaatgctagcacttttgacatcttcagtggtgattatgaagacacaaaaaattatcaccgtagctcccgtttgttgaacatgtactcgatgctgggctctggcccttgtatcccacgtctcacagaaccaccacataagccagataaacaaactatgcttagctccactttacagatgaggaaactgaggcttagaaagttcaaccatgtgtccatagttatcagggaaaatcatgagttatatctgaattctctgttgtcttccagcccgttccaggctctgaaatccaaggagacaggaccctgctctttctcaaaatagaaatctcaggactgggcatggtggctcacacctataatcccagaaatttgggaggccgaggcgggcagattgcttgagcccagaagttcgagaccagcctaggcaagagagcaaaaccctgtctctataaaaagtaaaaaacttagctgggtgtggtggtgcacacctgtagtcccagctgcttgggaggctgaggtgggaggatcgcctgagcccggggaggttgaggctgcagtgagctaagatcacacgtctacactccagcctgggtgacagagtgaggcactgttgaaagaaagaaagggagaaagaagggagggagggagggaggaaggaagaaaggaaggagggagggagggagggaaggaagaagacaggaaggagggaggaaggaaggaaggaaggaaggaaggaaggaaggaaggaaggaatctcagcacgtactaggcactcaacaaagatgtgatggctgaaggaaaatgaatgagcagctgagtgaatgaaaggtttgcccaggaggtgaggggatggggcagggcttgccagctgcagccaggtctttgccttcaccactttgtattctgggtaaagaaaagaaacagagaaatagactatgaagcctgggatttgtccctttctggaacttgggctgtggtcagggtgcttgagtgggtgaattttgtaacaggctcacgcctctctacccacttgtggcttttccattctatacattatctgctgactactttttatatcaccccccccccccatctcatacctccagaccttttccacttgcagtcctggtaggttttcagcaattttattttcacatcaacatcagtaagactttattaagatggagaacacatgctttgaggtgtcactgtggaaccagtacagaggtccctttgctatggggaaagaaattgtaaggtggaaggggggatgtctgttcactgggattacccatgaggcctcctttgcactgccggggctggcatgtcagatccatgggtgaccatgagttcactgtaggttggcccaaaagaactaaggcaggcagtggcctgtgcaacttcccacaggtgtgtggaggcaggacggcctgctggctgggagtcaggctgacctgggcttgaaccctgctccaccccttcccaggagggcctgcttcctagggctgtggtggagattaaacaagataatgcatgcaaactgataagcgatgaggaagatagtaagtgctcaataaatggaggctattattactagttcattagtatttatccagctgctaatgccaacaactgaaagtcttccaagggcttggattaagttaataccgggtttggcccaggaaaaggaggaaggtttgcatggtaactgtcacctctccttaaaaagaggaggaaatccagaagacaacaagcccaaggagggatgtttagaatcatcggtcatcagagaaatgtagactaaagacaacgaatgagatgttagtcccataggctggcaaaaatagcaagtgggattatgccaagtgcctgtaggggtgtaggatgtgggaaccacctatggacggggcacccagccattcaggaaattaggtctgtgcaaccttgggacccagtggtcccactctatcccaggtcccactatatcctgaggaaactcacacacaggcccacaaggggatgggtgcgagggcgtttatggcagccttgctggtgatggcaggagagagaggccatactggtgctgaccctgggggagtcagtaggagagatgtgaaggacacacatggaaggccaggtgtggtagctcatgtttgtaatcccagtgctttgagaggtcaaggtgggaggatcacttgaggccaggagtttgagaccaacctgggcaatatagcaagatcccaatctctagaaaaataaatatccaggtatggtggtgcacacctgtagtccctgctacttgggaggctgtgggaggagaatcaattgagcccaggaattcagagctgtggtgagctatgatcgtgccactgcaccccagcctgggcaacagagcaagacctagtctcttaaaaaagaatgcaaatggtggaggaggagacatgcccacggcaacatgggtgggtcttaacaacttaatgctgggagaaaacagaaaccccacaaaacaatacacacagaatttacagaaacaaatgcctgctcccgaaacactagtgcatgttttgcactaatgcacaaacaagagaatatgcaacaggcacaccagaattagtgcctgtggagtgatggggaatgacaggaaacaaataaataacaggaggggtcttgggtgggctcataaggaaaatgtgcatgaaccaaattaactctgccttaacacccgaggtgcaggatggtgagcggggagggaccggcttctgaggctgtccacatagtttcccacgctgggagtgccacagttcctgggacataaagaatccctctgtcctttgtatagtaggtataaatctcagactacaggctcgaggggccagaaataaaactttattttcagcatgtcaatgtaatttctgtttattttgttgtttgtttgtgtgttgacatggagtctcactctgtctcccaggctggagtgcagtggcatgatcttggctcactgcaacttctgcctcctgggttcaattctcctgcctcagcctcccaagtagctaggattacaggtgcccgccaccacacccagctgatttttgtatttttagtagagacggggttttgccctgttggccaggctggtctcgaactcctgacctcgtgatccacctgccttggcctcccaaagtgctgggattataggcatgagccactgtacctggcccataatttctatttcaagccaccattcttctgggaaagtgagaaagtttcatcttagtcatttggggctttccccaaactctccagaattttggccatggttgtggaatcttactcagtgctagtctatttgtagtgctgaaggctcatccgattctccatcatcaggacccaggccactgtcttggtctaggaggcccctttgggtctggactcttcacatctgtgtctttgccacactgaggacccaggaacctttcactattctgtcttcctagagcagagatcacaacctggaagcccacagccccctctacactacaaacacagttttgtttattttgttttgtttttggttttattttttggtccaactaactcatatttgttacctgcatttaaaactcaggagattttacatacaaatccagaagccctggctacattagactcacattcttatggggcagaggttggctggagctgaatagtgttctatcagtgaggaatgcttttagctgcaagtaataacaagcccaactaatattggctaaactataatcacgttcattgtgtatttaacaagaactctctaccccaaggttcgtttggcatctcaattatataatcaaaaatcagattcattttatccttctcccattttggcctcagcatatgagccttttgcttctactctcatggcttcatggcccaacatggctgcagtcactccaggaacatcctcacatgactcgggaggaggtgtggggagtgaaacaaaagaatagtctttcccagaagcccccttggccaaaactagataatatgggccattctgaagaaggatccagcatcacatcctgcaagggaggccaggaatgcaagacttagtcttcatcagcctgggcagagggaagctatcaggggagcgaggaatcaggcatgcctgttgggaggccaagtggtatctgccacaaaccgctgctccctaaatacagcttggcattccagtttgccacagtccccaccatcccctgttgctccccagcactgaagccatctatcactgtgcctgcagcacctccttccctcactggtgttgcttgctacacctgtaaggtttggatgctgccggcctcggactcttcatgcacagaagtgaagggtccacagctgctcatcttcatcaatcgctctctctctcttttttttttttttttttttggaaatggggttttgctcttgttgcccaggctggagtgcaatggtgtgatcttggctcactgcaacctctgcctcccaggttcaagtgattctcctgcctcagcctcctgagtagctgggattacagcgcctgccaccatgcccagctaattttgtatttttagtagagatggggttttaccatgttggtcaggctggtctcaaactcctgacctcaagtgatccacccaccttggcctcccaaactgctgggattacagacatgagccaccgcacccagcccaacttcatctctttactctccttcttcccttgtctcttgtcctaccccatttccctagccttgaagaattgccctcctttaagaaaatcaggcctggcatgctggcttacgcctataatctcagcactttgggaggcctaggcaggaggatcccttgagtccaggagtttgacaccagcctcggcaatatagcaagaccccacctctacagaaaatacaagaaaacattagctgggcatggtgtcatgtgcccgtagtcccagctactcgggcggccaaggtgggaggatcgcttgagcccaggaagtcaaggctgcattgaactatgatggcaccactgcactcagccttggcgacagagggagaccctgtctcaactgaaaaaaaaaaatccctcttaattcatgtttcctgctaagccattttgcctacctcaatctaattcacagttggttcaccaacggcagccagtccacaaacagctgctggtctacagtaacaaatatggaactgagagaaaaagtgagacatgtttacagcaattagatacggccacagcatccaagcacatgatcctacgctcatctcattgcagagggtgtaggcgagtttgggactgttgcatcacagggccaattgcctgtggtgtgagttgcatgctaatcacacatcgtgaaccacgtcttagtccccaaagggttagacatttggaaacggattcttccccacagagctgagaaacacaggcgtacacctcaggtcctcccagactctcaggaggacttggaacctcaagagccaggataactcatttctgctgttccttctttccaccttgctatgccccagcttgggctccatgatccacgatgggactgtctgggaggaagaatcccaaggcagcgtctcaaaacatcaccctgacacatttgccttcctgcctgaatcctgggctcacttaccacttctcacacgtgatgacgtgatgaggaatacctggtgcatcctggacgtccaattgtccacctcggaccaccaccccaggagcacttcctcagcagagaagttgaggagaaatttccagaaaatgtacacatcctcagcattttcttgagtatctgtccattaaacatatccatctagatatgatttttaaatggtctaatccaccatgtaaaatgggatctggagttgaacaggcccctctggagtgcccccttggactgcacagctggggctgagttcgcagggaggtcaccccggtatcgcaggcaggcgctggctcttttatgcagttatctccagttattggggaaacaggaaggcatggcatcaggctccaggatcggtgcagaaaacatgttcgcttcccaaggtacatgtagcggctctcctggcagctgtaataagggaggatggctctttcgaactgaaaatattttgaagatcccaaatctcacccagattctgagcagctctggcacatgagctgttttgtgatctcagatctcgggttcgtgttacatgggagggccgggcccagcttgtcctccctctgtccagaagagccttctgcggtgaatctcagcagcctggttaacgttgagtcataatattgccaataaaaggaaagaaaaatatggaaagggggtatgcagttggtgccaaagggagagggatttgttccctcaactccggagtggggctgaaggcatctttgaacctcagatatagtctcttctctcgggcctcaaggtgtagggtgcccaggagtgtggcagaaggcgggggttctgatctttctgggcctttctgtgccctttcttttgctgccaaagcctgggagacaggccatgggggcagtgtggggaggtagtgggagcagttttgttttttaaattaaggtaaaattcccataacatagaattaaccattaaccattttaaagtgtacaactctgtggcgtttagtgcgttcacagtgttatgcagtcaccacctccaattccaacacattttcatcgccccaaaaggaaaccccataacctttaagcggtcatgtctaatactccatcccccagccctggcaatcacaagcctacttttttttgtctctgtagactatcttattctggatactttatatgaatacaaatccctcagtatgtggccttgtatgtctgacttattttatttggcataatgttttttgggtttatttgtgtgtgtgtgcgtgtgcgtgtgtgtgtgtgtgtgtgtgtgtgtgtgtgtgtgtgttttgagacagtgaggcaggagaatagggtctggaggcagagaacctaaggccaattcatgctgacttcctagaactgaatcaaaaggaaaaccccacctctgcacacccaagtaacaaaagaatcagaggctactccctttgcaactccctgccccttttccactttgttgcagatgaaaaggagaaagtacctctgattgtgggccaagtcttcatttgcataggttataactttgtaactttacttcagcctctggtccttccttgcaaccagactggccgtgggccaagtcttcatttacttaaggtgtaaccagataaccaatgggaaacctctagaggatatttaaaccccggaaaactctgtaaccaggactcctgagctgctcccaccactctgtggggtgtaatttggtttcaatacatctgtgcttttgttgcttcattctttcattgctttgcttttttgtgcattttgtccaatcctttgttcaaaatgtcaagaacctgggcgactaatagtcaaggccctccaccagtaacaacagggtctcactcccattgcccaggctggagtgcagtggcgccatctgggcttgctgcagcttcaacttcccaggctcagatgatattcctaccacagcctccagaagagctgggactacaagcatgcatcaccatgcccggttaattttttgtatttttagtaaagatgggatttcaacatgttgcccaggctgatctcaaactcctgggctcaagtgatccaccctcctcagcctcccaaagtgctgggattataggtatgagccaccatgcccagcctcatttggcataatgttttcaaaggtcatccatgctgtatgtagcatgtatcagaatttcattcctctttatggcggaataatattccattgtatggctgaaccacattttgtttatccgttcagccgtcagtggacacttggatcatttccacctttcagccactgtgagtagtgctcctgtgaacttttgcatacaagtttttgcttaaatacttgttttcaattattttgggtataaacccagaagtacaattgctgagtcatatggtagttttgtatgtacctttttgaggaatcatccagtgttttccacagctttttatgcaccgttttacattccaccagcgtgtgtgagtgttccattcctccacatcctcaccaacacattttttctttttctttttctatctttattatggccaacctagcgagtgtgaaggagcagcagttttcagcccagacactcgtgttgggtcatgggacctttcccactctgagtttctgtaaactgaaggacaatgcccaccttagagagtagacagcagcgtcacataagtcactgtacatagcatccccagcacagtgtccaacatgagagatgctgttcactggggcactgtattagtctgttctcatgctgctagtaaaacatacctgaggctgggtcatttataaaggaaggaggtttaattgactcacagttccacatggctgcggaggcctcacaatcatggtggaaggcaaaggaggagcaaagtcacgtcttacatggtggcaggcaagagaacatgtgcaggggaactcccctttataaaaccatcagatctcatgagacttattcactatcaccagaacagcatgggaaagatctgcccccatgattcaattacctcccaccaggtccctcccatgacacgtgggaattatgggagctacaattcaagatgagatttgggtggggacacagccaaactatatcaggtaccaaggccacctccaggcaccatattacccagtgcttctcattctcactgtcatgaaggacaagggcttcttcccccatttagcgtaaaataaaaatgaatcaccagaatatgtattctcagtaggggaaatatcatcccaagaggggaaaaagtggtccctgggagtggagcaaaaacacatacacatacagtcccaaaacagatatacagtctaactataatagtaaaatttcatgggaggtggggcaattaggggagaaaaaaaaattataaaagaaccctggcgaagggtggcaataatgaaaaaaaggttgagaaacaatgaagtttaaagcaatttaaatttgtttaatttttattttataatttttaataaattaaaagcgtgatttttttattagatttaacaggcataaagtactgtattaaattgctctggaggtttaaatttctctatttatctcagactggtaataaacacagtggctttcaatttctctatttatctcatcatagactggtaataaacggtttgtgagcaggcaccaatctgcagttcacacctcagtagtgctgtgcagaagcatcactgcgtctttgtctgtctggaattatctcacttccttatgtatctgttcatttgattgttgtctgtctctcttacctgaatgtcagtgtcaacaccatatctaaaacagtgtctgccacacggtgatatttggtacatcactaggaaatgaattgttgaatgcctgagggaatgaatgaacaaattaatgattgaatgaatatccacttaaaaattgttttgctggctgggcatggtgacttacacctgtaatctgagcatttagggaggccaaggtgggcagattgcttgagcccaggagttcaacaccagctttggcaacatggcaaaactccatctctacaaaaaattagccagatgtggtggcatgctcctgtagtctcagctactcaggaggctaaggtaggagggtcaccagagtctgggaggtcaagactgcagtgagctgtgatcatgccactgcactccagcctgggcaacagagtgagaccttgtctcaaaaaaaaaaaattattttactgagtcaggcactggaggctacttttacttaaaacccaagaaaaccaatcaaccaaaaatggtagcagttctctgcctttgacagagactcaaaatagcaatgtcttcaacaagaaagaagggtatttctctctcacctaaaagtcctaactaatgtggccattctagtctgcaaacgtgatgggggtccaagctcctcatgtcctgttgctcagctgcatatccaagatggccccattccatggagaaagagaagctgccactgcccttcaaaatttactcctatccctttgcctagaactcatcatgtggccacatttagccatagggaatctgggaattgtagtttttattctaatcagccatgtgctcagcttagaaacagattctattaatatgagagagaaggggtgaatcaatattaggggaccctccaggagacctgccaccatcaccttaagaggatgtttttttcatctcatctttgccttccctcactgggcattgtatcagccagaaggaagaaagaggtcagtgtttcacattccagcaccaagctgggtctgtttgtcaaaaccctccagagaccacaacttgtggcacaagacttcaggggccacgtgcccccttcttcctgggtcctctctggcacaggatggatttctcactgcaggcactctgtggctgccctcacgctgtagtttgttcagctgtccattcttcagctgaccctgggtcacaaaatgaaaataaacaagagactattttggagaaagcataccaagggacaagacgatagcctgtttatttccaaacctgccctgagtcatcattcagaaggttcatgcaaaagaaaagagaaatcagaagagaaaacactgcagtcaggagtcttctgagacaggtggcttcctaagcttttgcaagtagggtcaccatggtaaccagaaccaaacagatgacctcgaatggaatagactgacctagaccttctgctaaatgtgtctgggcaggacattgaggatagagtgggattttgttgactatagtcaacaaaaatttaaatgtacattctcaaataactggaagagtataattggattgtttataacacaaaggataaatgcttgaggtgatggataccccatttaccctgatttgatcattacacattgcatgtctctatcaaaatagctcatgtcacccataaatatatacacctaatatgtacccacaaaaattaaaaatttttaaattaaaaaaaaatttaatgtaacgaaccaaattgtatattgagctgttggcacaaccacatagagaggaactatcttaaatgactttatttacacatatttttattcttttcctttttctttcttccttcctgatgtttccagcttttttatccttttctttctatgagaagaatttcctgtacccattctttctgggtagagctgctgtaacaaattcttttggttttccttcattcgaggatgtcttagttttcccttcattcctgaaggatattgtctctggatatagcattctgagttgatgtttcttttccttaagcccttgaaaaatgttgtgccatttccttccggcctccatggttcctgatgagaaatctgctgtcattcctattctttttcccttattctggcacattttgtttgattaataaatgaatgaataaaagaattaatcttagcttcacagcctactagctttatgacttgggaaaaactccattcctaagcctcagtttctctgtatggaacatgggaatggcaattatataccttcctctcaggatcgatgtgaggattaagtgcagttatatacaaagtgcctaatacagtgcttggtgcataaagcactcaataatctcagtggaatgaataaatgaatgcatgcatgaattaatgaactaattaatggcctcagtatctttgtgtagagaagccatgtgctgccatggaaaggccctgagctgggaagcatgagacaggcttaaggccttctctgctgccaagaccaaagcacaggatcagcactgtttgccttccctctttgtgcctcagtctccccatttggaccataaagaatttggcatggactattggttctcaattctcagtgtgtactaggatctcccagaaaggtttgttgttgttgttgttgttttcatatactgatgcctggcccaactctagactaactcaaatcagactctctgtgggaagggccctcagactgcttttttgttctgttttgttttttgtttcaagttctttgggagattctgatgcagaacaagggttgagatcctatggttctgatggatccatcatcttggataattttagaggtgttgtggttcctttattatcctcttatcttctcctacctcaccccaggaagtaagtttcctggagtccattgtgttcattttagccactttataaaaagtagtgtgggctctagaagcttcttgtttgatgtaagtcaccgctcatttgagtagccatttgttttctaaccagcaactagtgtgaatgtttagagatgtgcctgcagttgtgcggttgctgctttaaaacctctgacagcagtccatgccccttcagcagatgcaaaccatgctccaggcttccgggtcctgaagcatccagccctaactttcttaatctggcctcatcttataaaagaagtctgttgattcagtccaattcctaccaaaatcccagatggtgtttagtagaaactgacatgcaaagtaactaaaagccaaaacaaacttgaaaaagaacaaagttggagaacttatactacctggtttcaaaactcaccataggccgggctcagtggctcacgtctgtaatcccaacactttgggaagctgaggcaggtggatcacctgaggtcaggagttcaagaccagcctggccaacatagtaaaaccccatctctactaaaaatacaaaaaattaactgggcatagtggtgggcacctgtaatcccttgggaggctgaggcaggagaatcacttgaacctgagaggcggagattgcagtgagcctagattgcgcctctgcactccagcctgggtgagaagagcgagattctgttttttaaaaaaaatcaccataaagcttcagtaataaggataggatggaattggtataggatagataaatcagtgaaacagaataaagtccagaaataaaccttctcatttatggtcagtttatctttggcaaatgtaccaagtaattcagtgggggaagaaatggataccccttctccatgatgtgtttatatcatatttcatacttatatcaaaacatctcatgtaccccataaatatatacacctactgtgtacccacaaaaattttaaaaaataataaaatcagtgggagaaaggatagactttttatagtggtcctggaacaactgtgtgtgtgtatatgtatatatacacacatatacatacatatatatgcacatatatatatatgaaaagatgaatttaagtccttaatccacactgtatacaaagattaacttaaattggatcatagacctaaatacaagaatactgtgaaatttctagaagaaaacacaagagcagttctttgtgaccttgaattaggcaacaaaagcaaaatgcatcaaagaaaaaaatcaacaacctacaatcttttgctcttcaaaagacaccattaagaaaaagacaagccacaaactgggagataatattcacaaatcatgtatctgatcaaggacttgtgtccaagatatataaagaactcttataacagtaataagaggccaaacctaattttttaaaaagatttgactagggtttgatgggaaaaagatttgagtagatatttcatcaaagaagatatgtgaatggctaaaaagcacatgaaaaatgcccaacaccattagtcattggagaaatgctacttaaaaccacagtgagatacaaccacatacttcgtagagtggctgtaatcaagaagactgaaatgaccaagtgctggagaatcgagaactctcgtgcattaccagtcagaatgtaaaatggcacagccacttaggaaaacagtttggccatttcttttaaaaggtaaacatatgcttaccacacaactctgtaattctactcttagggatttacccaagagaaatgaaaatatatatccatacaaagacttgtatgtgaatgcttatattgcattatccataatagcccaatattggatgttgtacatctatgccattgtgcattgttgtttaatgggtacatagttccaattttacaagaagaaaaatgttctaaagatgaatgatggtgatgagtacccaataatgtggatgtagttaatgccactgaactgtacactttaaaatggttaagagggtaaattttatgttgtatatataccacaattttttaaataaataatttttattttttattttatttactgttttctagagacagggtcttgccgtgttgcgcaggctggagtgcagtggtgagattgtagtttactgcagcctcaaactcctaggttcaagcaatccccccgcctcagcctcccaagtagctggaactataggcatgcgccaccacacctggaatttttttttttccaagatggagtcttgctctgtcacccagagctggagtgcagtggcacagtcttggctcgctgctacctccgcctcccgagttcaagcagttctcctgcctcagcctccctagtagctgggattacaggcacacaccaccacgcctggctaatttttgtatttttagtagagacagaatttcaccatgttggccaggttggtctcgagctcctgacctcctgatcctcccgtctcagcctcccaaagtgctgggattacaggtgtgagccactgtgcccagccaatgttttaatttttttgtagagacaacatctcactatgttgaccagactactagagtggccataatcaagaagactgaaactaccaagtgctggagaatctagaactctcgtgaattcctagtaagaatgcaaatggcacagccactttggaaaacagtttggccatttctttaaaaagtgaaacacttaaatgaccaaactccggggctcaagtgatcctcccacctcagcctcccaaagcattggaattacagaaaaatctgaggccaccacacctggcctcaaattttttaaaaacataattattaaggaccaggatctgggtagtgggcactatctcacttatttctcaccatagccctttgaaaaggacaccgtttattttcttcatctatccaggaaattgaggttcagagaaatttggtaaccaaagtcacaggttccatcccagcctgtcagacctcaaagaccccacctggccatggtaccctcctcctgcatgttcctctccgactgtaagaaacctaacctggctcttgggtctgggccgccaacatgccatccggacagaggaagatccagagacttaggggtcacgtgagccatagccacggccgcatcagcaagcacttggaagcacccaggaggccgtggtgatgctggtggtaggcgtcaccagaggattagtgtcaacaagtctcacctgggttgctttgggaacgctggtgtgaggcattaccactaggaaccagagcttctgcccagctgtcacccttgaagccacatggagggaggttcatgaaatgctaacaactgctttaaagagaaaaaaagacaagaaccctaacctgtacccctgttcctccttcccacaggcacaacagggttctatcaaggaggaaatggactgggcaacgcagccggtttcgggagtgtgcaccaggtagacatggctccctcccgattctttcctcagttctttctggaaatattccccttacatcagggcacccagagagcccacgacacacacaatccccattgggaacctgcctcttagtccctgggtttggagactacaggggctagattgtgcaaaaggctgctggaaggacacagtatacaggcggagacgtaggaattgttagaagattcctgagatgtcatggagatctacaagtatgttccatcttgacctggactcaggacacccattgactgttgaatctgatatatatcaatacaaatgggtgggttctttcaccagaccatgggcttctcaagggggaccgtatatcttgctcacctctgcatccccagtggtgagagcccagcacacagtgggggctttataaatacttgttaaatagagcaaagtcaactctatataggtaaatgttggctagtactttgattctcttggtgtcacttacaaagtgaattaagagttcgcatctgctcaaagtgtgcagtaactctgctgtgtgtacaccttccctgtacacctaaaattatttcaaaacaaaaggttcacctgctttcaggctaccatttaaaacagaaccaccctggggtagatgggctttaggaatatttaacatatttagatctgaggaatacgcaatttcttttccagtgagaatctaaataatttaaaacttagcaaatgtaaaaattgtttcatgtatttttgcattatttctaatgtactatgtacatagataaaatacttataaataaaacagtactttttaagatgtggttcttaaccctccatttcaccattaaatctgtgtttttcaaaaacactgaccacccccgcaacccccacccccaggaactctgactcccagctctggggtggggcccaggaagcagaacgttccatgagttccgtgcagggttgagaagcactggtttggtgatagtgcggcaggatatttgaaacaatgactgttggagaattgggatcgctggtctgcttaaacaaagcttgatcaaaggtgattggcagctattgaattgatctccatgactccctcatagaatattctggacccctaatgctgtgtaggtgctgctgtatttgcacctcctccccatgaacataaaatgtcacctagtctcctgggtttgtgtgtcgtgtgggtgtgtgtgcggtcttctaggtttgtgtgtgtgtcgtggggggggggtgcagtgtggtcttaattgttaatgcatttgtttattaatttaaccagtatttgttgagttactgcatataccaggcactgtttcaggtgcagaggatacaatagtgaccaggacaggtgccatcagggccacgtctatatcccttagggtggcctgtggacctccaggtgccagcatctgcatgcctgggcccaaggggcttttctagaaccagtgcacggggcaggcaggaagtgcctgggaattaaagccccctgggtgcagctctcaaagaccaacaagttgatgtataaacccctccactcccttgacccgtgggagaggcagttctgagatgtggattttagaccatctcagcttttcctcatagggctcatctctggtcactaccacagaagcacctatgcaggctgctctcccgcatctctctcacttccccgatcccctgctggtgtctccttcaccttccaaacagcctccttgcacttgaatccttgccccggggtctgcttctgggaaaccaaaatgaagacagtttctgcccacagagagcttttattctaatggtgagacagagtggccaggctgaccaacggcccgagcccagaaaggcttcctcacatatgtccttggtttgtttttctcttcccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtaggtgcagtcactggtggggccattcatggctgtggtctgagagcttctatgaaggagggacccgcacatgggtcccaattgtaacaaacaggttacccaagggtcattcatggatgtggcctgagagcttctctgaaggagggacctggatatgggtcccagttgtcacaaacaggctcccaagggctaaatccatctctcagacatgttttgttggcctgtttgtgcatgtgtttaattgcatttacgtttaaaagtcagaaaattttataaatacctaaaaattctattttctggcttcttttgaaagaagatctggccatagtagccacattcccaaggaacaccacttggttaaaactaagtgtgtctgctctttttagaaaggacacacccaattccacatctagctagcttaccccatgttcattactgcctggcccatgtaggccttggagttgatgaaccctggtagtatttataatattaccagctgggcacggtggctcacacctgtaatcccagcacttttggaggctgaggcgggtggatcacctgaggtcaggagttcgagaccagcctggccaacatgatgaaaccccatctctactaaaaatacagaaattagcctgagtcatggcaggcacctgtaatcccagctactagggcggctgaggtaggagaatcgcttgaacctgggaggcggaggttgcagtgagccgagatcgcgccattgcgctccagcctgggcaacaagagtgaaactccatctcaaaaaattaaataaataaataaaatacccatctgtttcgtgctgagcacatacctgtgtggtcttctctaatcatttacttatatatttattcaacaaatatttggtaagctcccactgcattccaggccctccctttagtttgggaaataaagtgcagtgtagagttaagctttgcagacaggaatcaaataatcatacaaatatctcattacaaactgtgataaggagaggcataatcctcacaaaaacaggtttatattatccccaccctttttctagataagaacaatgaagatgagagtgataaggagcttgctagtgattggtggggctaggatcccaatcccagtttgttggcccccataaccagcactcctgctatgcactggccatacacagccaggaactgtgtacacagcctggctgtgtacggccaggaatatgttatctaaaatccgtttgagaacagaagggcagaggctttcaaatgttgattctttgtctaagaggggttcaagtatagcgactcagggtcctcaagaattatacaatccttcaaaacatccttaagcatgttcattttttttttctttcaacttgtattttaggtttggggtacacatgcaggtttgttacatgggtaaattgcatgtcgtggaggtttagtgtacagataattttgtcacccagataatcagcacaatacccactaggtagttttccagtcctcaccttccttccatcctctaccctcaagtaggtccttgggtctattgttcccttctttgtatccatgtgtactcaatgtttagctcccacttataagtaagaacatgtggtatttggttttctgttcctgtgttaattcacttaggataatggcctctagccctatccatgttggttcaaaggacatgatcttattttttatggctgcgtagtattccatggtgtatatataccacattttctttatccagtttgccattgatgggcatctaggttgattctttgtctttgctattgtgaatagtgctgcaatgaacatacacatgcatgtgtctttatggtagaaaaatttatattcctttggatatatacccagtaatgggattgctggtatatatccaaatggtagtttcattttaagttccttgagaaatcttcaggccgctttccacagtggctgaactaatttacattcccatgaacaatgtataagcattcccttttctctgtaaccttgccagcatctgttattttttgactttttaataatggccattctgattggtgtgagatggtatatcattgtggttttgatttgcatttccctaatgaccagtgatattattttttcatatgcttgttggctgcatgtatgtcttcttttgagaagtgtctgttcatgtcctttgcccattttttaatcgggttatctttaaggatgtttgtttctgatggcacaatagttttaggaaacccttttgattagccaagattttttggcttcaaaagacatagaaaatccaattcaaactagtttaagaaaaagcaaatgaacttttaggcatatctaacctagatgtacaggggtttagagctaggtccaggtgttccaatgacaatgttgagacttagtttctctcttccttctggctctgaattttcctgggttcgttccgttctcaggcaagctcctcccctatggtggcaaagatggccaccagctacccagagctcaatcctgtctgctaatccatcccagcaaacatagttcctccttcttagccattcctgcaaaagtcccaagtaaagctcccattggcccagcttaggtcacatgctcatccccaaaccaatctctgtggtcagtggaatggaatgctgggatgaagcagcagactttgggctcatgcctacggctggagctagagttggggtcagcctcacctcaaccaccagggactgagagtgaggaagaggtgatcacctcaaaaaacctagagcattgtaactacaagaagacagaagagacaatgggtgagcaaaaacaataaatgtccacaaccttgatatggatgccacctacactatgagcaacatgtggcagagtccatgtcctgacccctctgtggtcacagaacttagtatgtaacatccctatgcaactaatgcaccagcctgtggattcattcattcattccccagacctgctatgcacatcttctcttttacaaggtggttttggcttatcaacattaaataacatggcagcaatacgttagaatgtcagtagatatcactgagtttcgttcctttgtcttcttttctgaaacctactgatgctgtagggctttgcagaagctaagctagcacgatggtgtggagacagtcatcaacaaatattaattggttgattgttagaaaaggaacaatagggaagacccacctgttttgttcctggggttcttggtgtggctattgattttagcccttaaattttccatcactgggaatgagtgagttatccttggtttgatgacaaatggagacaatatggcaaagcatgttaaataaagtcaactttttaaaaggtttagagcttgagcattgattttggtcattgtgatctcatcccagaatatttaatgatgcatagtacctatttaataactttctttgaagagtttgaagtttaacaaagtttttctctgtcatcatcttgaattatctttagccatcctgattttcagaatgtggttcttccgatctcatttcaacaaaggagataaaaacaaaacattgatgagaaattagggcagagaggaactataagcaggaaaccatcgagtagatgccactatccgtctataattcaatggtgaactgaatggcaaacgaaaaacttacctccccagaatttgagttttgtgggaaggttctcttcattcccatcaggagtgaatataaaggctcattgtgtctttgaaatttttctgtcttgtttccctctgttcttcctttatcccttgatcaaaggttcaacagtaagtggttgagatggtttttactgtgtgtctaacaagctgacataaaatctaatgacgtaaataatggtcagctgtagctgaggtctcctgcctctttttcctagtgttcactgtaaaggaatttaagcatatgtgtgtgcacatgtgcacgtgcgcgcgcgcgcgcacacacacacacacacacacacacacacacattcatgcactctttttaaatttcccataaaaactctacttttgaaattatccaggatatccttgagtggttggttccaaactccagaggctctagaggtttactgacagacagatcacactcactgtgtgcactgcctggatatagtattttggtgctctcaccactcacatcccccatgcaccccatcctcgccacaggacactctgcattgacatgcattaatgtgtgtgtgaagtgccaacaatttgcagatgattacagggcaatttgctgatatagagggcagaatctgaacatctcatgttacttaagagaaaaaccaaatcattggttacttaaggatttttttctttttacatttttaaatatgatacaaattatctaaaaagaagttgaaggattttttaacttctaagatcaacttcctttgccaagagaagaagaatttttttaatctctcaagaagaaattgggaaggctcttccgtgtaatttggcaacatctaacaaaatttaaaatgcatagaccttttaactcaactattcgacatctaagaatttatccgaaagataaactttgacctaggtacaaacacttaagtaaaaagaatacttatttttttcactgattaaaaatttattaatactattatgcaaataattttagtgataaccacaagggttttgtactgttagtacataaatacatacaaaaatgcattttgaaacttcttgtatcccctttatccttttcaatttctgtttatgtttgctctacaatatatatgatggatctgtgcagtagaaaattttttgctgatgagtatggtacaatcagaaatgtttggagactgtatcagtttcttcttgctgctgtaacaaattattatgacctttgtgtcttaaaacaacacagtgatattttacagttctggaggtaagaaatgcaacatggctctcactgaactaaaattgaggggtcagcagggttatagtattggaggctccagaggagaatcacttccttgcccttctacctgcagaggccacctgccttccttggctcatgaccctgcatcattccagtttctacttacattgtctcatctccttctctaactcctgcccccgaccccttataaggactgttgtgattccactgggcccactcagagaatccaggatcatctccccatctcgaagtccttaagtcagtcacatcaagaatatttatttttttaaaaaagaatatttattgcagcagcatcatagcaaaaggctggaaacaacctggataccatgccattaacaggaaacaggttaaatcaatcatggtgcatccaccagtagcatactatacagctgttaaaaagaataagttagatatatttgtgctactatgggtttctctttgagctattgtgataggttaaaaaaaaaaagcaggaggcagaattacatgggtaatgtgagcctgagttttttaaaagtttaagtgtagcttaatacccatatttactcatattccataaggaatttctagaaggatgcaataagaactgttaatagtcattttctctggagaggaaaacaagatctggagtgaaaggaaaagactgtatgtaacaggcaatctgtagaacactccacccaacagcagcaaatacacattcttttcaagtgcacatgggacatttaccaagataaatattaatatcttctgggccataaaacaagtttcagtacctttaaaagaatcaaggcatacaaagcatgttctctgacagcagtggaattaaattagaaataaatttcagaaagatttttgggaagttcccaaatcttcagaatctcaataatatacatttcagtgacccatgggtcaaagaagaaatcaatgggaaattaaaaagcacttggaactgaatgaaaatgaaaacaaatatatcaaaatttatggaatgtcattaaagcagtacttaaagggaaacttacagcacgaaatacctgaattagaaaagaagacacaattaccacaggtatcaggtgaaggaagggagggagggaaatgagggaggggggagggagggaaatgagggagggagggagggaaatgagggagggagggagtaaaggggagtggaggggagggaagattggtcaaaggatacaaaatttcagttaataggaataagttcagaagaactattgtacaatatggtgactatagttaataaataaggtatttgtattagtctatcttcatgctactgataaagacacacctgaaactgagcagtttacaaaggaaagaggtttaatggagaactcagttccatgtggctggggaagcctcacaatcatggctgaaaaaaaggagaagcaagtcacatcttacgtggatggcagcaggcaaagagagaactcgtgcaggcgaactgccactttcttaaaaccatcagatcttgcgagactcgttcactatcacaagaacagtgcaggaaagaccctccttcttaaagagacaaggtcttactctgtcacccaggctgaagtgcagtggtacgatcatagttctccgtaacctcgaactcctgggctcaagcaatcctccctcagcctctcaagtagttgggactacaggtgtgtgccaccatgcgcagctaatttttaaattttttgtagagatggggacttgctcctccttgtcttcggccatgattgtgaggcttccccagccacatggaactgagttctccattaatgctctttcctttgtaaattgttcagtctcaggtatgtctttatcataattcagtcacctcccactgggttcctctcatgacatgtgggaattgtgggagttacaattcaagatgagatttgatggggacacagagccaaaccctatcagtgttatatacttgaaacttgctgagagagtagattttaagtgtttttagtaaaaaaaaaataaaaaatatgtgaatgttaattagcttgatttagccatccccaatatatacatatatcaaaatatgttgtacatcataaatatacacaatttttatttgtccagttaacaaatcatcatcatcatctacagggttgctgtgaaaattgaaataaaaaggccgggcatggtggctcatgcctgtaatcccagcattttgggaggcacaggcacgtggagcacctgaggtcaggagttcaagaccagcctggccaacatggcgaaaccccgtctctactaaaaatacaaaaattagccaggcgtggtgccacacgcctgtgatcccagctactcaggaggctgaggcaggagaatcacttgaacctgggaggcagaggttgcagcgagccaagattttaccactgcactccagcctgggtgacaaagcgagaccttgtctcaaaaaaaaaaaaaaagaagaaagaaaaaaagagagagagagagaaagaaaaaatgtgcattgcctattattattattttgagacagagtctcgatctgtcgcccaggctggagtgcgatggtgtgaccttggctcactgcaacctctgcctcccaggttcaagtgattctcctccctcagcttcctgagtagttgggattacaggcgcccactaccatgcccggctaatttttgtgtttttagtagagacggggttttaccacgttggtcaggctggtctcaaactcctgacctcaggtgatccacctgcctcagcctcgcaaagtgctgggattacaagcgtgagccactgtgcccagccaaccctgccaattattaagtaacatgcaaatataaataatgattaatgaaaatatatttaagaactcactttaacccagacagttaaatataataattttcatccaaagatatgattatttaacttaatttaaaattttttaaaaataagaaaagaagaagtaaaacttcatgaagtaaagagataaaatgacctggtcacctatgtagaaaatctgatggaatctatgaaaaagctactagatctaaaaagtaactttagcagtgttgcagggtactaggtgaatatctaaaaatcaacaaacaacaggaaatagaatattttaaatgccatttgaaatagtatcaaagatgtgaaatactcaaggttaaatttggcaaaagatatgcatgactttacactaaaacctataaaactgctgagagaagttaaagaaggcattaataaatggagatatatacctggttcgtgaatcagaagacttaatattgttaaaatgccagctcttcccaaattgagctataagattaatacaatctctatcaacatctcaggctttttttaagaaactgtcaagctgtttctgaactttaaatggaaatgcagaggaccaagaagggccacaatgacttttgtagagaagaacaaagttagagggctaagactacctgattttaaaatccattttaaagccacagtacttaagacaatgcagcactggcataaaaatagacaaataaatcaatggaacagaattgagagttcagaaataggttgggtgccgtggctcgtgcttgtaatcccagcactttgggaggccgaagagggaggatcacttgaggccagaagtctgagaccagcctgagcaacatagcaagaccctgtctctgcaaaaaaataaaaataacccaggcagtgggttgtgcctgcagtcccatctgctcaggaaggtgaggtgggagaattgcttcagccaggggtttgaggatacagtgagctatgatcataccactgtactccagcctggatgacagagtaagaccctgtctccacagtaaataaatgaattaacccacatgtatatggtcacctgatttttgacaaaagacaattcaatggagaaaggacagtcttttcaacaaaagatgctggaacagccgagcacagtggctcacgcctgtaatcccagcattttgggagtccaaggcaggtggatcacctgaggtcaggagttcaagatcagcctggccaacatgatgaaaccccgtctctactaaatatacaaaaaaatagccaggcttggtggcgcacacctgtaatcccagctacttgggaggctgaggcaggagaatcccttgaaccagggaggtggaggttgcagtgagccaagatcatgccaccacactgcagcctgggtgacagagcaagagtccatctcaaaaaaaaaaaaaaaaatcgtggaacaactgattatctatacttcatacctcacatgacacacaaaaaaaatgcaaaatagatcatagacttaaatataaaactgtaatcttctacaagaaaacataggagacagttttgtgactttgatttaggcaaagatttctcatatgtaacaccaaaaatatgatccaaaaagaaaaaaagaatataaactggacttcatacaaatttaaaactgttcagagaatgaaaagaaatccatggtccaggagaaaaataattgcaaggcatatctcgaataaagcatgtgtttatatagaatatagaaggagtgttcaaaatccaataataagaaagcaaacaatctgataaagaaatgggcagggccaggtgcagtggctcatgcctgtaatcccagcactttgggaggccaaggcaggcaggtcacctgaggtcaggagtttgagatcagcctggctaacatggtgaaaccctgtgtctactaaaaaatacaaaattagctgggtgtggtggcatgtgcctgtaatcccagctactcgggaggctgagtcaggagaatcgcttgaacccaggaggcggaggttgcagggagccagaattgcgccactgcactccagcctgggcgacagagtgagactttgtctcaaaaaaaaaggctggctctgtgcagtagctcacgcctctaatcccagcactttgggaggccaaggacggcagattgcttgagcccaagacttcaagaccagcgtgggcaacatggggaaaccctgtctctacaaaaaatacaaacattagacaggtgttgtggtgcaggctcgtagtcccagctactcaggaggctgaggcaggaggatcgtgtgagcccgggacatcaacattgcagggagctgtaattgtgccactgcacttcagcctgacagagtgagaccctgtctcaaaaaataaagaaataaaaataaagaaatgggcaaaatatttgaacagatgatagatgcctcaccaaagaagatatagggatggccaaaagcacatgattaagatgccaaatgtcattaatcattagagaaatgcaaattaagttcacaatgagacaccactacatacccactggaatggctttaatcacaaagacggaccataccaagggctggcaaggatgtggagcagccagaactctcatccactgctggaaaatggtacaaccactatggaaaataattcatctgtttctttctttttttttttttttttttgagacaggttctcactctgttacccaggctggagtgcagtggtgtgatcatagctcactgcagcctcaacctcctgggctcaagtgatcctctggcctcagcctcctgagtagctgggactatgggtgtgtgccatgaaacccagttaatttttgtattttttgtagagacgggggtctcattatgttgcccaggctggtctcaaactcccagggtcaagcaattctctcaccttgacctcccaaagtgctaggattacaggcatgagccaccatgcccagcctcatccattttttcaaaagttaaacactacttattatatgacctagcaaacaagctcagtaaaaataaaaagcttacatctagaccaatgtgtgaattaatgttcatagcagccttattagaactgaaaactagaatcaacccaaacgtctacctacaggcgaatggataaacaaattctgatgtatccatacaattgaatagtactcagcaatagaaatgaaatattaggctgggcatggtggctcatgcctataatcccagcactttgggaggctgaggtgggcggatcatgaggtcaagagatcgagaccaccctggccaacatggtaaaatcctgtctctactaaaaatacaaaaattagctgggcgtggtggtgcatgcctgtaatcccagctactcaggaggccaaggcaggagaatcgcttgaaccggggaggcggaggttgcagtgagccaagatctcaccactgcactccaggctggcaacagagggagactctgtctcaaaaaaaaaaaagaaagaaagaaatgaagtatcgataaacaccgcatgtactgaatctcaaagcaattatgctgaccaaaacaagccagaaaaaagaatacatactatatgattccaattgtttaaacctctagaaaattcaaaccaaagtctatagtgaaagaaagcagtttagtggttttctggggagggtaactggaggaagagcttatccaaagggataacaaggaaattcttggggtgctggatttgtttattatgttgattgtggcaatggcttcacagatgtgtacatacgtcaaaacttaagaaattgtgtactctaaatatgtctagtttattgtatgtcagttgtgcctcagtaatgcgttaaataagtaaacacattaaaagagagaaagaaaaagaatgaaattactccaagaaaggtttacataaattgtgctatcctgtggatctctgactgtgaccttgaacttttactctgtattagtctgttctctcattgctataaagaaatacctgagactgggtaatttataaagaaaagaggtttaatggctgggcacagtggctcattcctgtaatcccagcactttgggaggccaaggcaggcagatcacttaaggtcaggagttcgagaccagcctggccaacatggtgaaaccccatctctactaaaaatataaaaattagccaggtatggtggcgtgtgcctgtaatcccagctaaagaaaagaggtttaattgtctcatcattcctcaggctgtacaggaagtatggtgctggcatctgctcagcttctgggaaggcctcaggaaatttgcaatcatggcggaaggtaaaagggaagcaggcacgtcttacatagccagagcaggaaaaggagggggtcaggggaggtgccacacatttttaaacagccagatctcatgagaactcactcactgtgcggtacccggggaggggagatggtgctaaaccattcatgagaactccatgcccatgatccagtcacctcctaccaggccccgcctctaacactaaggattacaatttgacaggagatttgggcggggacacagatccaaaccatatcactcctcattctcaagaatgtgtacgtttgggtaaaggcctgggtttttctgtttgtttttttgttgtttttttttttggcacccctgcgaaattggtttcacacagaccttattttagacatttcttagataactagcatttacccctctttttaatatttgcctgttttaatggggggggcaaacaaatgttttctaagcccagtagccttaaactaccaagtgaaccaggaaagaccttatttacattgctcttcagcatctgtgaattgagaagaaattctttttccagaggaaagtctttgctcactcaatgtttgggaatctctcatgctgcatcctgaagactctggggaggtggaaaacacccagccatcctgacagcgcaaaatcatgtcttgtcttattatgtccttagtctgttaagaagcttttataaatattaaataaacaaagttcagtcccttgggtcttaaagggaaatagttctttcagtgtagaaaaaaactctccctagccaagtctttttagacaaaggattttcccctgatgatccaagaactggcaattagggcaggaaggatggggtctgtgtgacacatttgggagctaaaccaagcaactgtaaagtgagaaaatgggatgggatgtcctcgaaggttcacgctgttttacagttctgtcactcacgagtgacaaggacaggtccaaattttagttctggctttgccactcatttgcagactcacatggtccagtaagtcacctcactaaacctgagttacctcgttagctaaataaggatagtaaagtacaatcaaaagccatgcatttaaaacatctgtgcgtaagcagcaacacagctctgatgctggctttaggacctgggtcggggacagtgctgcttcacttgttggggaccactagacaatcgccggtgggcacaagtgtgacagcctctcagtggggccacacccaggagcaccccaaagtgagaagcagcaaggacccacattctgtgctgcgtctctcactaatccacacatatccatgggttgactccagccagaactccattcaagtcacctcctaactgccaggcctgtgctagatgctctcgcctatataatctcatttacttctcagattgacagctctcagcaggtaaagcttaaaaggcttgcatttaatagagaagtggcggggcacagtggctcacgcctgtaatcccagcactttgggaggccgaggcaggtagatcacctgaggtcaggagttcgagaccagcctgaccaacagggtgaaacctcgtctccctgtctctactaaaaatacaaaaattagccgggcatggtggtgggtgcctataatcccagctacttgggaggccaaggtaggagaattgctgaatccaggaggcagagtttgcagtgagccgggatcacgccattgcactccagcctgagcaacagagcgagactccgtctcaaaaaataaaaattaaaataaaaaaatagagaatagagggagcccagcagggagaggaaagtagagaatccttcccatgcagcccccgtttacctctggggcagagagaggggaatcttctaaaggtggaagagtgtaatgctcagctacagataaatacgtgttgccctccttctgttcatctaggcatgctcaggatttcagattgagagagttgtaaatgcataactcctccatcattacagcatccagtggcccctccctcactccctgaccgaggccttccctgactagccccatataaatgagtcacctttcagccctccccgctgccccaccctgattgattgaatacttgattggttgattttagagaagaggcctcgctctgttatccaggttggagtgcagtggcgctatcatagctcactgcaacctctaactcctgggctcaagcgaccctcctactctgcctcccgagtagctgggactataggcatgcaccaccacacgaggtcaacttttctatacttcatagagacagggtcttgctatgttgcctaggctggtctcaaagcaatcaagcgatcctctcaccttggaggtgctgggattacaggcgtaagcccccacgccgggccccctgacttgttaattctctgtggcacatttccctcccgggcttggtgtatgcttacttgtcgatgtgtctgatgactgtctcctctcactagcgttgaagtgctgtgagaaccaggacataatcccactgcctggagcagtgcccgctgaccaagtgtctgctggatggatgaaagataatgaaggtcaccaatgggcaatttaagggacttccaagggcagttttcatcctacgagatctttgcctctggtgctgccttggaacccactgctttggagctagacggtgctgttgggatatttcccaggaggagacacccagcaaagcttctgatttgtccaccattccctttcttacgccaggtgaatacaacacacacaatggaccttccacaccagcgaaagagggagacacagacaggccgcaccgggcctccgacgggaagctccgaggccggtctaagaggagcagtgacccgtccccggcaggggacaatgagattgaggtaatccaaaggggctctgtgtgacctggtgaatgtaatctccatctgaggcccaaacaagagtggggacagagttttctccaagtacgaggcggagaatcgcccttcgtgttttacaaagcatgagcagggaagcatgaggttgtccaagcaggtagtcctggggccaggacagaagagaggttctcaaactgaagcagcatcagaatcacctggggggtgggggatggtgcttttgaaatcagggattgctgggcctcagcccaagagtttccaattcagcagatctggggcagggcatgagaatttacgtttctgacaagcccccagatgattatgatgctctggattgaggaccacactctgagagtccctgataaagaaaagaatgggcctccgaccttccagctgggttaaagtggttctctaccctggttacacagcagaatcatctgggatgctctttaaaaaacagataccctggccccatcccagatcaattgaaaagactcactggaggaactaggggggaggaggggagttttaaacattctcggtggggactctaataaggcttagatattgatctgtgtggaggctggctctaatgagtgtgcctctatttctgggattctgggattctgacttctcagaaaggggctctcaacctggactgcacacgacaatcacatgaggactttgagaaaccttcattatcaagttgcacctcagaccaattaaatcctattccctgagggtagaagctaggcatcagtgtttttaaagctccgtgggtgattcctgtgtgcagctcaggctgagaactagtggtcagggatgctccaatctttttttttttttttttttgaattggagcctctctctggctcccccatcacccaggctggagtgcagtggcacaatctcggctcaccgcaacctccacctcccaggttcaagcgattctcttgcctcggcctcctgaatagctgagattacaggtgcacgccaccatgctcagctaatttttgtatttttagtagagacgaggttttaccatgttggccaggctggtcttgaactcctgccctcaactgacctacccgccttggcctcccaaagtgctgagattacaggcgtgagccgccatgcccggacttttttttttttaatcaggtatacatgaggttttcaacaggttgctatgggatacatacagatagtaagatgataatcatcatgaaacagattaccaagtctaccatctcacaaagttactttttctgtctgacaaaagcagctaaaatctacttatttaacaaaaatccctaatacaatataactttgttaactctaattcttgtgttgcacattagatctctatacttgtcatttgttatgcaagtgtagtagtattggccaggtactgacattttcccaaaaacaaaacattatgcctaggggagggtaccagtagaaataggcaaaatggatgccccaaaaccggaagtaagctactgttgtcttatcaagggaggaaaatgagcaaactcaccggtttatacttctttgaaaaaggcagtcagttgctggcctgagtgtgctaggtgtctcggtaggattgtcagtgccaggcagttcaagtacaccagcgtcacatccctatttataatctgtatactttatgcggcagctgcaatgctcagccacaaactcaaacacactgagaaagatcacctttgtcatttccttaaaaagcaatgtaattttaaccctgagtccccatgccaccagatggtaagaaatttcatttcattattagggaccctccactcccaggattaaatgagaatccaggggtcaagtggtctcagaaaccagaccagcctctgacgtccagtgtggctgggtggcccctgccaccttcattgtcaaagcctgcagtcgtcactaaaagtccagccactctctggtgtttccatgctatacaatgggtatggaaatctttgttgagcctgagaaccttgaaatatttgctacaattctttggttgcaagcaacagaaaccagtaccgggcccagcacagtggctcacgcctataaccttaccactttcagaggccgaggtgggcagattgcttaagtccagtaatttgaaaccagcctgggcaacatggcaaaacaccatctctaccaaaaaaaaaaaaaaaaaaaaaagccagccatggtggcacacacctgtagtcccagctactcagggggctgaagtggaaggatcaattgagcccaggaggtagaggctgcgttgagccatgaccacaccactgcactccagcctgggcgacaaattgagaacctatctcaaaaaaaagaaaccagttctggttacttaagcaaaaatgaatttactaggaaaggacaatgagaggaggccgtaaaaccaagtttagaaagaaagtaacaaagacattgttgagaaatctaggaatgccagaaagcaaacattttagagtgcagtgtcctgtccttcggtgtccgattccaagaagacagtatcccagtggcctagcttgggtcttaccccttaattgacagccccaccaaaatagcacacaatggggaaggaaaactaggatgctcttttcagaagccctgaagttggaagctaggggtggggaccgggacctccaagcaacacatgctgacttcagcatgttcagggcatttgatatttagccagtggtccctagttcacctgtagcagttgtttatagctggggtcggttctgatcaccctggaagatattaaatatcctgaacatcatgcttggtgccctacacttggtcagcctcccgagatctaccagtagccttgatccatgctagagacctggtgcagagcaagtgttcccactgttcctggggccattcttagtccagggaattctgtccttgctttttgccttgttcttaaagctccatcctttccccaaatagaggagattttgcacaatcccttcagtgggtttaggcctttgcaaaagactgaaagaaaacgtattggcgtcaggttgtacttgctgtctgccttcccatattcctagaatctcctaccagcttgaagttgcagagcttcgaaaacacagagagccacacatacataatattccctccccacaagaaaattattcagtcacctaacatgttttctgctctctgtaggggaacggcgggggtagagagagatttttccattaaactgagaaagaggtggggagggttatggcatagaagtcagggattatagggtgatattattctggaaacatctgcttcttgatttcagcataagtaccactggcaagaaccattgaaaaggtgtgagctgtgtttcacttctatgcttaatgtcatcatagaaggtttgcttgggtcacacctcttaagtctttggctgttttgctaatgactgaagcccacgggagagaaattatgtggaagtggaaaggaggaaaattctgagcatgtattagttaaaatccttcagctgcacgtgccagggaccaacttgagctacttaggtgaaaaagcagaatttattttaaggatacagggcctctcttagaacttaaggacagaagtagagtagagtatcagcgaggcactggaaccagcaagggagacagggacaagaaactgcatgtatgccttctcttcccatttgccacagtgaagatgacagaactcccaaactatagtgtcctggccgtgccttcatgtgctagttactgggcacagctctcctctgggcctcctcactcctcctttccctctactcccaatgaaaccaggtcctggtaaagtgttagtttgtttgtatctttcaccttctgttcttgtctctggagactacctgtcagatcccggggtctgggtccagcccatgctgaagtccgaggggagtgggtggatgggcagaaagaacactcagggggccataggaggtgaaatgtagttttatttagcagctttctcatcagcagctttctcacattagctgtctcacattgtccacctttatctcggctgtctgcttcagctctgcggctcctgctgccctgacagctgcagccgcgcagccggctctcccttgccttcagggtcagcagcttaactcttcccctctctgggcaccagcgcaagctgtgctgtggctcccctctgtctatctgcaaaacagtcattctcccttacaggggcctgtagcttcattccctctctgggcaccagcgcctgcacaagagccacattgagccaaactgagccaagagccatgccctgtgcacagcgtcagcagggcaattatatcttctaaagacagtagtgactgcaagccaagtatgaactacacaaacaggttatataacaagtggaggtatgcacctgcacgccaaactcgctgagtcacgcaggcctgggtatccatctcagcctagtccttgaccaaagcacatccatgtgccttacgctgcccttgtctccccttcagatcacatggctaaacttggccaccaatagccctccccaaaagacaattactttcttcctagccccaattttaaattgcaaaataaaaggtctctgacccacccatggttaaggacgcaccctggtctgcaccatgatggcctagggaatagggtcacctgcagaatggccaccaggaacttacccactaagaatcgaggatggtgaggtagtaggagaaagggatggatttttttcagaggggatttaatggataaagtaagggagcctgcactaaatttgaaaatatttgctgatttttaaaagttctattactgaaatttctaaatttaatttcctaagttcaaccccagtgaattcagataagttaggacttggcatatttgaatctcagaaggtccttctcaaacactgattttcaaacatttttaccatgacccgtaataagaaatatacttactatgatggcccagcatatatatgcacataaatataactggtccaaaagatttatgaaataatacttagccttactaattgcttcagaaatccctgtactagagaatctgggatgctaatacctttttcattctagatatttctcttaactttcaaaggcatggcaaatgccattgtgttaatacagccattgacctccagagagttttaaaaggtggcccactcaagattgcatactggggagggacatttgcctccccttctcaacactagctacagagttagtcaggtcctttgtccttgaaaataatgatcaccagaaaaataaagaaaatcaacagtatgaaaaataaagaacaagattagccaggcgtagtggctcaccatgccagcactgtgggaggccaagtggggaggattgcttgcattcaggagttcaagaacagcctgggcaacatagcgagaccctgtctctacaaaaagaaagatcaaaaattagccaggcatggtgccacatgcctgtagtcccactactcaggaggctgaggtgggaggatcgcttgagcctggagaggtctaggctgcagtgagtgatgattacgccactgcacacaggccctgtctcaaaaaaaatttttttaattaaaaacaataaaggccaaggtaaataaatgggataagttagaagtgaagtaatttaagaaacataaaataacttaggaaaattctaattggttttcatataaaaactcaagatcttgcatccataaaataaaaagtggaggctactgggaaaggaatactcagagggaaaaaaagttattggaaatcttttaattactgcaaaaatcaaaaatttaataagggttataagagaaagtttaagaaatctcccagaacacagatcaaaaagacagatttattaaaaaatattatttacaaggaaaggcagtatcaacccaaaaggtttgatttgactattgggaatttcacaaaaagaaaacagtagaaaagatgggagaaaattattaaaagaaataagaaaataaaaattttcagatctgtagaaagatgcaagtcattgggttgaaaatgctgaagtgccaaacagaattcattaaaaagaagaccatacccagatatatcttcatggaatttgaggataccaagtgtaaagaaaagatcctttaaaattctagaaagaaaaaaaaggtaaaacctacaaggactgaggaacagtgaaataccagatttctcatcagtgaccctggacacttaaaaaaaatgatgaaagaattctttcaaagatctagaggatattgttttcaaattggaattctgtacccagagaaactatagagaaaaataaagataacttcagatattcgagaattcaggaagattactttccatgtaccatttcaggaaaagcaacttaaggatgtattcaagcaaaacaaggaagaaaaccaaggaagagagacttgggatccagaaaacagtggatccaacccagaaatacaatgaagggaagtctgcagcaagcctaaaaatgatccagtccacattggaggtttctatcactgaggatagatatctccaatacagagtgtgtggctgaatttgacattttaatgaaggtacattgttgcaaacaagaaaaaattaataaattctgacaaaaccaaaaaagttacatcagacaggtatgatacatatatgaacaaactgagatatgacattattttaattatgatggagtacaagtaaagagaatacatacaatggtaggggcattctccttaaaatcaatctggggatatgacattggacacatagagaagacaatgcaatcttagcatattacttggctctgtagtgaacaataatcacaaaatgtaaatgtatattactagttaccaacttttaaaattgacataggcagagtgcagaaaatttaaccttagttataaaaccaatgtacaaacaagtttatcctcattgacaatatgaaggtaaagctacagctgatagacattagagcggggaggatgtatgggaaaaggtagggactcccatatcgatagctccatgtttgtttacctttttagccaagggagaatgtccaaggagaattggaatagagggactcacatatgagaaaaatgtaagtttccagagaaacaacagagatttccatgagttaaaccctcatcttttaagactgcccagtcaaaagatattgtctcaagttgaaaaatcagtaagggtataaatatgttacttagaattatagaggtgatcaccagacttgctaaaaacagaaatagttgagcgtatggtgaacagtgaatttaaaatggtggtatttcattttgtaaaacgagttatatgattttcgttgttgattttggcctgaatcctcctttttgagcttttatatggaaggcaaggacagacttcttgattctgacatcttttgagttgataagagcccaaaaactgggcatccgaatacacatgacacagataaggttggatggggattcatgacacatcagtgagttacatgttttgtaactaaagataatgtttttcgagacttcttttcctccaagggaatgaatttctgcagacattaagtcagatgcacgtgagtccatttttctccattctcttcctctctttcatcacagcgtgtgttcgtgtgggacttggatgagacaataattatttttcactccttactcacggggacatttgcatccagatacgggaaggtaagaatccattttgtctctctctctctttttttgttttcaacgttattgtccagccagtttgtcctggaaattgtgcggacagtttatgaggcagcttctccaacaaaagctgccctttggggtcagcccaggtttaaaaattcctatgacattttcctttgccatgtgaaaatttaattagcttccccttctattgtcttccatgccttttcttccaacgtttgaagcaatcaacatttacttgataggaaatacacttgttgtcttcagccgtctcccttcctaagacagtgggctatggtgcagccaaagccagtaattctagctagaaaacgaggtaaagtacttttcttcttccctgttgtttatcctagtgtctccggcagatgaatttaattttccttctgtttttttgagacaagggggaggcattgtcagctccagtgtggatcttagcaatcgttttgcaaatgtatcatcaacaaattatgtcggggaaccatctagttagaattctaggcaaatgctattggctgaatcgtggtggatggaagagaccttgaaaccactttaataatgcaaaaatgaactcaactgctaaaactcaaaccttgtcaattatttgggttcatcccatgggctactgaacagacgacgagtggatgccctagacatctgtcatctcttcaggggcacgcatggggtggaagggcagtacttaagacgacagcctagttttcatctcctcagaggtgagtgacccactggcagctgcttccacgcatgggtaggaaccttgagacttgccagcgcctggaaaatatttctgtttctgtttagagaccaggaatatgatttgacatcacttcatggcttttccagctgctcatgttttttatgggggttataacaagctggatgtgtaattagcaagatagatttatcgtctgccattatgttgtaaagaatataaaaatggtgttggtggtgcagaaatctcttgccgtgtaggaatgccgttaatatgtctagcagtgcctgtgggaaatccagcatgcatttttggactgtgcacagcttaggtaaaagatggcagagtcaagagctgctgaaaacactgaagaatgggctccacagccattgcaaaaatttgggctatcccaaaggggccacagtagtaagttgcctgctaagtcgtggtgttttatggttttcctaaccactcctgtaaagtcacctcccctgagacacaggcactcactcatcttgcccttagaggcagcctgctgtgaagttccatagctccgtgcaacaactcacttagtatggattgtgtagggatgtgtgatcttgggtatgatttttgtatctgtgtctcaccaacattcctcaaaccaaactgtgggctccttcaagtcagagacaaagccccgagttcctttctgggccccatgtcccctggcccatgccattcctcactgccagccacctctctcccacctcaccacccaattccagccaccttcacctccaactcggcttcctatctggtctcccagcttctactcttgcccactgcagccccctacattggagtcatcctgaaatgcaagcttggccatatcactctccagccgaaaaatcttcagtggcttccccattgacaagcctacccccagcctccaaggctcttcatgagtagcctcctgccccattctccagcctcctttcctgctcttaccctgagttgtttttggtccttgaacctgccacattctctcccatcgctgctgggtttctcccagaagatcctgagacaaagagtgagtgcgagtaatctatctgggaggtaatcccaggaagtagtggggaattcaggcaaggagggaaaggaagccaatacaaattacacaaatataatagttactgccgtgggcagttggggctaagtcccaccagggacagtgttaacccacccaaggagtgagggagctgggatatttacctgcaaattcccttccattaagcgttgaaggcttttcctggaaattgtctccttgcacttctggcctgtccccaagaagccgcagagggcagccttggtggctgacacctataatcctagcacttcgggaggccgaagtgagaggattgcttgaggccagcctgggcaacatagtgagaccccatctctttaaaaaacttaaaaattagcctggtgtgatagtgtgtacctttggtcccagctactcaggaagctgagaagggaggatcgcttgagcctgtggtgagctatgatcgcaccactgcactctagcctgggcaacagagcaagaccctgtctcaatcaatcactcaatcaataaaaagagagccccagggtagagcatcacaaatgctaactgtggaaggtttcttcatatatgtacaggaatggtgacagttgaggggacgtggagctggggcacactggaagcctctgctataatctaagatgttctagaatgttcttttattaagttaaatcctacttatctttcagttctcatttaaaacgtagcttcctccaaaaggactttcctcagtactcctctccatctaaattgcgtctgtcctcataactgtgttttccattcatgtcataattatgtttatttttattttatgtcttccttctaggctataagcaccataagggcagagaccatgaacatttttttttatttccccaaccacgcgcagtacacagggcagaattgctcaataaatatttgttgaatgaatgaatcagggtgatcccctagaatgttaagctgcacgaggacagggacctttggtttggtttggtttggtttggtttggtttggttttgttcatagctttatcaccagtgcatggaacagtgtctcccacttagtaggtgtcaagtaaatatttgttaaatgaaggaaggaaggaaggaaaatagtatcaaaacagaaatttttaactggtggccgctggccaaattcatactgcagatatttctctttggcccccagagtgtttgaaaaaatgtgaatgtgtcgccaacatttaaaaatcaggagattgcacagaccaaaacaatctagatttccagctcttcttgaaaaattagaaatctggcaatcctgcattcccctggggccacaatcaacaggagcagaggaggactgccctcttagggggggtggacattctccagcccatcgcagcccccacctggcctggttaacccattcttgggactctctggccccattggtatctgagtttcaacatccatcctagaattacagaatcatagaagattagagctggaaggacttgagagatcatcatgtccagttagtctccatcgtccataaggagaaactgaggctcagagggagtaagatcatccaagaaagcatgagaatcagactcaagctcacctgccttcctgtgtgatctctggatgtccagggaaaactgaggtgaaaagctgttagagcacccagatcgcctgtgccatcttcatgactctcctagaattttccattccctcctccagctctcgctaaggtgaggaatgaatgagtattatcatttgctaaatctagcaaccttcagagagacccaaaataattgtgacttaaacaagatgcaagtttatttcactcccctgcagtccagatggaagcagttcaagctggggaaactgctgtgcagcaccagagaccacagcctctacagtcttattccctgccattttttggagtgtcaccagcattggcaagataaatcatagcttacccccatgtctgcattccagccagtaagcaagaataggaaaagggggacttgcccctctcttttgatatttttattttcttgtccctctttttttattatttttattaatttttttagagacagggtcttgctctgctgcccaggctggagtgcagtagcacaatcatagctcactgtaacctcaaactcctcactcaagcaagcctcccacctgagcttcctgagtagctgggacaacaggcaagtgccaccatgcccagctaatttttaaaagttttttgtagagatgggatctcactgtgttgcccaggctggtctcgaactcttgggctcaagtgattctcccacctcggcctcccaaagttctgggattacaggcctgagccaccacacccagcaagccccacttttttaaaggccagactcagaagttgcaggcatcacttctgctcttatcctattgggcagaacttggtcagatggcctcatctacctgcaagggagtctgtgaaatgtactctttatttgaggctgtcatggccagttaaaatttagatattctattactctgagagggagaaaagaagaatgggtattagaggacaactagcaatttctagcccaaagtactgtatagtaaaaggaaaaacaattaaatagaaaactgatgaggaaacataaaattagttatgtttgagaggcctgagggacaacaggatttgtaggtctgaagctccagagagaggtctgcactatagctctaagcttggatgtcagagaagtaataaggatgtagaggagaagtgtgagccccattttgcagacagagtgactgagatgagacctacagaagttgtgtagttggtgggatattcatgacagaaccaaaactcatggcctcagcttctggctcacagttctttctctctgtacttccccagcactgcagccatgtgaaacttgttattaatagctgtcatcaagtatgacattcagtttgaagtacagcatatttaagctgcaaagaaaatttattgaagcacaataattgaaaaacccagggatacctgggattcaggtctggctggatccagatgtttaagcaatgttcttaggtcattctgtatctcttagccaattttctccatgtggtaactccctctcagcaatcccaactaaaaactggaaatttctagtacccacattccagcacaacttctaggcgttaatgccaatgtcccaaactgggtcacatgcccatccatatgccaacctctgtagctctgattggccagccaaatcaagagcccactcctggcatgggaaaggaggggcagatcagctccacctcaaccaaatagagtgagagagggaggatggtcccccaaaggaaactggagtaatccttccagaagagtatgaaggcccatggatgtccagtgaatgggcactggatgccaagatcccctgaacatccatgacaagaaccagcagcactttgcttgtggccatcatgctgcataccatgcaggaagccaaaatcattaatagtaccagccagagtggggacttgctgttttttgggggaactaagcccaacaaagctaaaatgattggggaatgattcaaaataggttgtttgaattttaagacagaaactgggctcccgttctgttcccaatcaagggatgtgctgcttgaggctgtcatctcttcacttcctttccatttcttcctccccagtgctcagagccagaacatccctttggtagctgtatctcccagcatcttgtggatccattagaaattccctagagagctggagcagccagtgactgctgcctctttcctaacccctcccttcccctaccaccctcctccgcagtctctgaactctgtttttttccagctggtattaggcaaatgcaaggtggtcaagagcctttgcctgtggccaggaagggattctaaaagaaattagtcagctttcctccagggattcatggggagttgccctgactcctccttttgtgccttgccttctaggcagcccactaccaatatgaagctcaactccaggacctgttgttgttgttgttgttaataacaattttattgagatacaatctacatatcataatttaccctttcgatgtgtacaattcagtaatttttagtatattcacagagttgtacaaccatcaccactctaattttagaatattttcatcaccccaaaaagaaaccctatactcactagcagtcacccctgccatttccttctccccctggcccctgacaaccactaatctactttctttctctacagatttgcctcttctggatatttcatataaagggaatcacacagtacgtgtgatcatccgtgttgtagcatgtatcagtactccattcctttttatggccacataattttccattgtgtattagtccattttcacatggctataaacaaatattcaagactgggtaatttataaaggaaataggttaaatcatctcacagttctgcgtggctggagaggcctcaggaaagttaacgaacatggcagaagaggaagcaaacacttccttcttcacaaggcagtaggagagagaaagttcagagtgtagggggaagagccccttgtaaaacgatcagacatagtgacaacccacccacccaccacaagaacagcatgggggaaaccacccctatgatccaatcacctcccacgaggttcctccaccaacacaaggggattacaatttggattatgattcaagatgagatttgggtggggacacagagccagaccatatcacagttcatggataaactatattttgtctatccatttatcagttggatagttgaagtttgggccattatgaataatgctgctatgaacattggcatacaagtatttgcatgtgcatatgtttttaattctcttaggtatatgcctaggagtagaattgctgggccacatggtaactctaggtttaatgcttttgaggaacagccagattattttccaaagtgactgtatcattttaccttcccatcagccatgtaaaatggctccaatttctccacatcctcatcaatatgttattgtctgcctttttggctatagtcctagtaagtatgaagtggtatctcattgtgggtttgattggcatttccctaataatgttgacaagtgactagtgatgtttttatgtgcttattggccatttgtatatcttctttggaaaaatatttattcaaatcttttgctcatttttaattggtttgtctttatatcattataagagtttttatatatctggataccagtctattatcagatatgtgatttgcaaatattttctctctcattctgtgagttgtctttccattttctttgtggtatcctttgaaataccaagctttttatttttatgaagtgcaatttatgtatattttctttggttacttttgcttttggtgtcatatctgagaccctattgcctaacctaggtcacagagatttactcctgcacttttttctaagaattttctcattttagctcttacatttaggtctgtgatccattttgagttaatttgtgtgtatgatgtgaggcaggggtgcaacctcattgttttacctatgactatcaagtcgtcccagtagcatttgttgaaaagactcttctttcccctactgaattgtctcaacatcctgtcagaaaatcaattggcagccaggtgcagtggctcacacctgtaatctcagcactctgggaggtccaggcaggtggattacatgaggccaggagttcaagaccagcctggccaacatggtgaaactccatctctactaaaaatacaaaaattagccagatgagatggtgcacgtctgtaatcccagctacttgggaggcttaggcatgagaattccttgaacccgggaggtggaggctgcagtgaaccaagatcatgccattgcactccagcctgggcgacagagccagactctatctcaaaaatttttttaaaaaatcaattggccgtaaatatgtttatttcttgactcttcattttatcccatagatctgtatgtatgcccttatgccagtaccacactgtcttgattactgtagctttgtagtaagtttcaaaaatggaaagtaggagtcctccacctttgttcttatgaccagtcttgacctttataattggcatctccattggttttattttttgtggttttaacatagcctttgcacttgctgttgttccctgtgccaggaatgcccatctccccattttctacatggctcctttattcacgaatctgcccagtggctgggcgtggtggcccatgcctgtaatcccagcactttgggaagctgaggcaggcagatcacttgaggccaggagttcgaaaccagcctgtccaacatgatgaaaccctgtctctactaaaaacacaaaaattagctgggcatgatggcaggcacctgtaatcccagctactcaggaggctgagacaggagaatcacttgaacctgggaggcggaggttgcaatgagctgagatcacgccactgaactccagcctgggcgacagagcaagactctgtcccaaaaaaaaaaaaaaaaggaacctgcccaaatgtttcctcatcaaaccacctgatgcgttaaatatgtattatttattacctgccctctccaacacacacacatttgaatgtaaactctatgaaaacaagcaccagggccaggattagccttttgtaggcacaaaatttaagtgggtactgagaaacagagtaatcaagctcaatcatattttaatgcaatattttacaaatcaaaattgatgccaaaaaatcgatcatgaaagaaaatcaaaatgtaaacaaagacagatggttgtgtgtgttactgccctgcgttattgtgcaatgggaacagtttccaatcagcccctgactccctggcctgagtgactgttacctctccacagggcaggtttatgagccttggcaatggcaggaacagattggccaacgagaggctttaatatatagtcatcttttgtgttttgttttttgtttttgtttttgttttttactgtagagcttttattaactttttccacttgagtcaaaatacagaaaaatgttttgataagtgtatgtaggggccacatttttcctcttgcctcaggccctgtggcttggcctggaatggcaagcaccagggtggtctgcctcccagctgtagcccccggacctagcacagggcctggcacatggtaggagctcagtaaacgtttgttgattacatgactgtaatcaagggagtattttaagtgttagtagcagggagagatctcaacccacacagcatgcatgaaatagaattttggttttctgtaacgcaatggaattcctacttgcagcctttgttctgctgggttctttttccttcctcaccaggttatatcagacttccagggagctcacaaagcacccagggattgggtgagagtccatggacccacgagtcctctgtccacttacgacactgctgacatgtatctggttcctgtccctaggggtgcttcaggtctggtgggatctggaatctcagtgaggctggctatggtcctatctgcctgaccccctagcccagactgtcactctcttaggttttgcttcctggcacacgtggcagggtagggaggcctctgaaaacccccttccatccttcagttgttggaagtcaggacaagaaaccagtgccactcgctcagcatcccaaggccaaaaagctcaaaatctgctaccttatgaatgggaggctggaaaacagggaactgagggagcagagagtaacaactcacatctcgcccatgttcttgttggcggatacatcagatccttgagggagcgaactggagtagaagggagtgtttggaaaagggaggaatttgcagttgtcacggtgatgggaggcacaacaaacccgtgaatcaacccaccaagataccattagtggtctccatagaaatgtgtgcattttctcattttattcaacaaatatttatcaagtgcctcctgcatgccaggtgtactgttctaggccctggggatgcggcagggaacaaagtccattaaaaactctgccctcatggagctgatatccttggggagaggaaggaagatgataagcaagacacatagaaatgcaagtggccaggcacagtgacacacgcctgtaatcccagcactttgggaggctgaggcaagtggatgacttgaggccaggagttcgagaccagcctgcccgttatggtgaaaccccatctctactaaaaatacaaaaattagccaggcgtggtggtgggcacctgtagtcccagctatctgggaggcttgaggcatgagagttacttaaacccaggtggcagaggttgcagtgagcctagatcatgccactgtactccagcctagacaacagagtgagactctgtatcaaaaaaaaaaaaaaaagaaagaaagaaatgcaaggccaggcatggtggtgtacccctgtaatcccagcactttgggaggttgaggcaggaggattgcttgaggccagaagttcaagaccagcctggacaacatgagaccctgtctctaaaacaagaaagagagaaagaaaaaacaaaagagaagaaggaagaagaagaagaagaaaagaaaaagaagaagagagaaggaaaaaggagaagaaagaagaagtaggaagaggaagaggaagaaggaagggaagggaaggggaaagaagaagaaataagaagaaataataatccagagaaaaagagaagttgaaattaaatttgagaaaaatgtggccagggaaggaggccacacagagaagctaaattttgaataaggcctgaaggaagtggaggaacagaaatctggtggaagggcagagggaatggcacatgcaaaggccctgcagcagaagtgtgcctggggagtttgagggacagcaaggaggccagtgtggctggagcacagcagactgactcttaagttggagctggtagagatttggagtagaaggacagagtctgccctggtttcagtatggtttgttgagccccacaaagtctcatgttgaaatttcatccccattgttgaaggtggggcctaaagggaggtgtttggatcctggaggtggatccctcattaatggcttggtgccattcttgcaggagtgagtgagttctcttagttcccgtgagaactcgttgttgaaaagagcctggcagctccctccactctctctcttcctctctctccacatgtgatctgcacatgctggctcccctttgctttccaccatgagtggaagcagcctgaggcctcaccagatgcagatgctgttgccatgcttcttgtacagcctgccgaactgtgagccaaataaacctcttttctttatcaattccctagcctcagatattcctttatagcaacacaaatggatgaagatggaatctgagttccattcttatttatctttattttttatttatttattttagagacagggtcttgctctgtcacccaggctggagtgcagtggcatgatcatagttcactgcaacctcaacctcctgggctcaagcagtcctctcacctcagcctcccaagtagctgagactacaggtgcacaccactgtgcccagctaattttttttgagagacgagggtctcagtggctggtctctactcctgggctcaagcgatcctcccccctcagctttccaaggtgctgggattacaggcgtgagctactgcatccagcctgagctccattcttaaggagcccctctggctctccccggggagaggagagtagaaagtggccaggttggaatcctggcgatgggtgaggaggctactgcaccagtttatctgaaagactgaactggtctttctcagtttaccgttctctccacccagggagtggagatgcaggcggggaggagcacagtaggctgggtatattttgaaggcagaccagccacagataaagaaggtaaagggagtcctaattctcaccaccaagctgcaaagatgccctgttttccatccagggtctccccctgaagagacctgattgcttctacccctgttggcaaccagccaattcctcctgaacaaattcctcaagctttactgcacatttcctatacaccaagcactcactatcaattttattattttcttaagttaagcctcaaaggcacagcttgagttattcatattctttgtccacacaaggcccctttcttgtttcacgtaggtactaccaatgtgtttccttttaaacctatttgtgctcctttccctcccctccctatatagctcagtgtatagccttttgtttgtttcctgtaacatatacattctctttttgtgtgcatttatttcttatgtgtataggtgacattgtttaaataccctgtgtttcttacctttctccctctgtgctatggtttcacttatttatttctgagacaggggtctcgtcatgttgcccacgctagtctcgaactccagggctctagtaatcctcctgcctcagcctcccaaagtgctgggattacaagcatgaggcaccacaccctgcctgcactatggttttagatcctcccacattgccatacatacaactctatcactctaacacaatagtttttaaccagaggaagttttggcccccaggggacatttgacattccccatttttggggaatgggatactactggcatctagtgggtagaagccagggatgctgctacacatcccacaatgcacaggatggccccacaataaaggatgattgggccctccgggtccatagtgctgtggctgggggcctgcatctgaccgctgcatagtcccaggtcctccaggtcttccttatggcactctcttcagggaggacactcaggcttcctcagctccgcatcagcacagacagagctgtgacgagcaacctttatggactgctctgagctttacaccctctctctcatttaatccccaccatgaatctataaggcccagctgctccctttatactcatttccagagaaactgaggcccagagaggtgatgtgacttagtcaaggtcacccagcttaggagggatgaaagccaggaagtggcccactgctctttaatttattttttattttatttttctgcgacagggtctcactctgtcactcgctgaagcacagtggtgcaaacacggctcactgcagcctcaacttcctgggatcaagcaatcctctcagctcagcctcttgtgtagctgggaccacagacatgcactaccatgcccagctaattttttatgtttttttgtgagacagggatctcactttccccaggctggtctcgaactcctgggcttaaatcccaaagtgctgtgattacaggcgtgagccaccatgtccggccgctccactgctcttaaccacgtaacatgtccctagtgatccatgtgactgtctcgagggtaaaaattaaaagcctctggaatgaactcttctgctgcctcttagctcgtggagcacagggactgggtctgatgtgttcacagctttatcccaatacccagcacagtacctggcacctccactggacaaatatttgttgaataaacaaataaacaaagggctgccaggtagggagttttcacttgtgtgatggcaaatacagcagaaataagattccagggcattcacccacaagggagcagacagccacgtgtgtgacaagcaggggcctggcagcctctgtctcagactgagatgctccatgccccctagcctggcctcacctagagcctggcccacagcagggtctcagcaaaggcttcacaattttgttttcagacattgcatccatcccctccttcctgaaaatgtctttgttctactgtccttcatggcagtttggctgggtatagaatttttgtttggaaataataattttccttcatagttttaaggcattttcccattgactctggcttccagagaataaatgacaggtgcagttggtcctaattgaagtaggtcagaaggtgctgagaaagacatcttgaagaagtgaaattggtaaaatacctggtacatctgaatgcattgagaggatttttaaaagatcattatttactccaacggaaaacaaaaggcatgagaagtgatcatagtttactacctggcttagctgtgttatcagttagctacaaaacaatcaccccaggacttagtggcataaaacaataagcatttattattcagcccatgagattttgagttggcagagaggttctactgagctagactgggctcttgcatgtgtctgcagggtcagctggcagatcagctggtagagaatggcctgagctgggacaacctgtctctgctccatggggtctctcatcctccagcaggcaagtccaggcttttcctcgtggcctaagaagtgttcctttcaaggagagagacccgtctttagtcctccatttggaactggcgtgccatttggaactggcacactgtgaaaagtgggcagcactgtaccctggggcttagaaacgagcccagatcatttctgctgcattctgtcagcaaaagtaaacataagccagcccagatttaaacagagcagtaaccccacctcttgaagggagaagctttactatcacacttcagagggtgaagatgtaaggacattgagtcatcaaggcagtcagcctatgcagtaatcacagcagcgtgaactctgactagtagcccaataaaaaccattcacttttgagaagccgaggtgggcagatcacttgagcccaggagtttgagactagcctgggcaaaacagcaaaatcccatctgtacaaaaaaaaatttttttttcaaaaaattagccaggcgtggtggtgtgcacctgtagtcctagctactccggaggctgaggttgaaggatcccttgagcccaggagttagaggctgcagtgagccgaggtggcaccactgcactccagtttggccaacagagcaagaccgctgtctcaagcaaacaaacaaagccatgactatttaggaggaaaagagaatgagaaggatacatatgtgcggtaaaggtagcaagaagaaaatccacattgcccatagtgggatcaaataatgcctcaaagtgaaaaatcaaaaagccatgtaattataaccatgcaatttagagacagggcagtgagtatcaagataatgaatgaaggaaagagttgaaggtggtgacaaagggggcatgagagggtgtgtcagggaaactgcagtcttataacaagccttgtggaactttttgagcatttgacaaaaattaaaactattaaaaattaaatgatttaacttgattatattatgcatataaaagaatgagttatgcaagactatatctgatcagctccttgctgagaggagagattaggcatagattggagaaagaaggtatctgcatggctcagatagtcaaggaagacttcctgtaaaaggaagtatcagctgagacttcaaaactaggccaaaaaaaaagcacttaggcacgtttgggagtttacagttcattcttacattatttgtcttaattccacaaccaccttcttgaggtgaataaatcaggaattattgttactcttcttattttgcaaaagagaaaacagttccagggaagttgagggacttgcctgaggctccagaagcagggaatggctccaaaagttagatttcatgttcactcctttttttttttttttttttttttttttgagacggagtcttattctgtcacccgggctggagtgcagtggtgatgtcttggctcactgcaaccactgcctcccaggttcaagcgatcctcctgcctcagcctccctagtagctgggattataagcatgcaccaccacgcccggctaatttttgtatttttagtagaggtgggggtttcaccatgttgaccgggctggtcttgaacccccgacctcaagtgatacgcccacctcagcctccccaagtgctgggattacaggtgtgagccaccgcaactggcagattttacgtccaaatgcaacaaaggctagctgtggctaacttaaccacaaggaaattgattgggagggtatgagggagttttcaggatccaggagaagaatggaggaaaagttggggctcccaaggagcaggagtgatgaggtggcacctttaggccttacagctgctgtttcatccttgaattgcttcagtcccaggagagaggggctgatcggctgtgcctgggacctgtgcccacctctcagctaagcagggttagacaccttgatggacagcccaccaagccacctgcagtgggggcaggcagttccccatgaggaacctaaggagcttttagcagaaagaatgagaatggatgagaggcagaaaccatgggtgctcatgccaggagcagagccagcctccacatccacactcggggctgtctgctctgaaaggtgggtagcgctgtagcctggagcttagaaacgaacctcagatcacacactttgtattcacccactgcaaaggtcattcccaggctgagatttctccagagagagaaatgcccagcatctgccaccagcacacccctccttaagggaaacccactctcctgagacacacagaccataatgtttctgcttttcagagtgaatcactgcctcagacacagctgagcccacatcaaattcctagatgggttttttttttttgtggatatgctgtggtttcaagggggagatctccactgtgcttctggggtttcttatttaaatggaactaggtgtcattcaaagtagcagtggctgggatcaccacatgttccctgacttgcctttttagtgaccatccacacagatatctgtttgttccatgactcttggactcatgagtcagctcttctgtcgggggagaatgggcagaactcacaggcagcctcaaaggctctgtataagacacctgttggtgtgatggctacagaaacacaccatcctctcatccctgggggcagggcaggtgaatgcccatgtcacagatgagaaccctgaggctcacctcgctgaagtgcctgcactaaaagcctctggaaaaggtctttcacacagggttttctgtccccctttaagggtgacgtttttagcctttcctcttcagaaggcatgaaaagcttcagccttggccggccacggtggctcatgcctgtaatcccagcacttgggaagctgaggctggtggatcacctgaggtcaggagttcgagaccagcctggccgacatggtgaaaccccgtctctactaaaaatacaaaaattagccgagagtggtggtgtgcgcctgtaatcccagctactcaggaggctgaggcaaaagaatcacttgaacccaggagatggatattgtagtgagccgaaatcgtgccattgcactccagcctgggccacaagagcaagactccttcaaataataataataataataaagctttggcctctatcaaagacactgagagagtttggatatttgatccctgccccagtctcatgttaaattataatccccagtgctagaagtggggcctggtgggaggtgttgggatcatgggtgcggatccctcatggcttgtgaggatcccacatggcttcacaatagtgagttcttgtgagatctggtcatttaaaagtgtgtggcacttctccgccactctccccctcttgctcctgcttttgccaggtgaagtacctgctcccacttggccttctgccatgaataaaagctccctgaggcctccccagaagctcagcagttgcctgtgctgtgcttatacagcctgcagaactgtgagccaattaaacctcttttctttatagattaccctggctcagatatttctttatagcaatgcaagaatggactcacaaagatactttcgggcatgccgaggcaagcagctgaagggtcttcatagccaaatttgctcacaggtggggcctcctgcccacctcccaactgcccaccaccttacccttctcccacctgccagagggattgcttgaaaatgcaaatcaggccctgcaatgaccccctcttgctgccagggaagcagactgctcccaaggaccccctgcccagctcatcgctgccgtcttcagccgtcttccctggccatacaggtgcctttgctcacccagggcatcaaattcccaactgtctgggcctctgcgtatgctattctgaattcttagaatattcttcatccttcttttttactcctgttattcactgggaggctcagcttttctttcataacacagttcagaagttacttcctcgagggtcccccagagtaagtcaggtcacccgtcttatgctcacgtaactctcttaactgacccatacgccaaccatcatcattgctgtgtctgtctcttgaatcccatccccttctctccagctcccccaccacctccttcatttcagcctcctccgccctctccacgggtctggacagctgcctccctgcttcccctctgcctccaccaccctcagcctattgggcagccaaacaactgcttcaagaggcaaatgggattgtgccaccttctccatcctcacccggtggagaaccctgcagtgatgctcactgcccttaaggcaaactctttgccatgactttccaggccccgggcggtccagcccctgccaaccttgccaactttcaccttgatctctttcacccacccccagcactgctgcagcctcctgctcacatgcacttcccaccacagggcctttgcacacactgttgctctgcccagaacactcttcctaccctcccttagtctaaccagtgttgcctgtccagtgtggtatccttagggacgcttcccaatctttccaagttggttaaaaacctcctactgatggttcatagcaccacagtgctcatagtagcacagttgcaattatttatttctgggtgtgattatttgattatagaataacatcatcatccttcttttttttttttttttttttttttgagatggagtttcgctcttattgcccaggctggagtgcagtggtgcaatcttggctcactgcaacctccgcctggctagttcaagcgattctcctgcctcagcctctcgagtagctgggatgacaggcgcctgccaatacgcctagctaatttttgtatttttagtagagactgggtttcaccatgttggccaggctggtctcgaactcctgacctcaggtgatccacccacctcagcctcccaaagtgctgggatcataggcatgagccactgcgcccggcccaccatccttcttaaaaggctggaattgaaacctcattataacagattctgtcaatctcccctcccccattattcccgtagcactctgctcctttgggtgtgacgatgtccctctgcaggcacctgtgaccctctgcagtgcgttgggcagtgtcccagagggacagagccccagtggcccaggcattgacctgctcattgacccacccttccttcccctccactctcacgctcccactgtgtcaacagcccttcctgagatcacctcccagaaaaaccacctgcatgtgaatctttggctctgggtcagcatcctgggagacccaaactaagacatcgaggatgtatgaatgctgggactccatgattgctgctgcagggatggaaactcctcttagtagagccctgctgtgacataagtctcctggctactgaagggcggtctggcatcaccaggtagctggcagaaatgcagagtctcagaccccgctgtagactcactgaacatgcatctgcattttttttttttttttttttgaggcagagtcttgctctgtcacccagacttcagtgcggtagtgcagtggtgtagtggtgcgatctcggctcactgcaacctctgccccctgggttcaagccattctcctgcctcagcctccccagtagctgggaccacaggcgcacgccaccacacccagctaatttttgtatttttagtaaagacggggtttcacgatggccaggctggtctcgaactcctggcctcaaatgatccgcccgcctgggccttccaaagtgctggggttacaggcatgagccaccgcacccagccaagcatctgcatttaactccatccccaggccatcctttcacacattcatctgtgaggtgagatggagccccgaattcacctggtgttggcttttcttgcagatccagaggccaggtcgagagagcatgacctgatctccacagctcctcgaccggctcctctgccctctccgttccaccacagtcctccccgattcctccgcgggtgttattacgtgattccggcttggattccggaatccagaacccagcacaggactgtagggattcaatcagatccagttggcgataggcggcttggcctgtctgttactgctttacaaactgagaagaaataaaaagaaaaagaaaaagaaaacccggttttatgacgcagcagttaaaaactatttgtagaagttgctaaggttcaaatcaaaagtgccctctctcgaggactattagttaattcagaggaccacagattctttccttttcttccttttcccccttctaccttgaaatgtagctgtaattcatttctgccgttcatacagctagagctttccatcctgtgacaaacacaagccaaagtgcttaaggacatctgtttattttatttctttaacgagaaaaccttccaatttctcctgagctcagctgtgtttatttacattttcttggtcatgtgaggcgagcaccttggaagtttaaaggcctggccagacccttgcaggagcctgtagctctgaaacggagaggaagccctgcccaaggaaaacagagtccttggaactctataaaatagattctcaaaataaatactgcctcattcacttggtagatgtggattaagtcaagatgaatacaatttgaaaaggattttctgaggaagtcggagatttctttcccccactgggggttaaaccttgtatttaaatctctcttcccccttccctctctcttttcagctgagtaaaaggtgtttagtctttgtggctaataaagaaaggatgactttgattgggcttctccagcagtgattattttctttgcagcacggctgggagaaggagagtgacctcactagtcactctgtcccatcctgtaaggagtgagggcaagaagcaaacatctgcagttgtcattttggcgggggtgggtgaggaagaagttggaacagccttgagagatgtcccggaggtgaatgacattgtttgaggtgttggatgggggtggtaccctttgttggcttaatcccttataatgatgcttccctaagccagggaccttcatgccaagtacccccgcttatgtattttacagcattaaaggattatttccaacataaaatatattttaaagatggtttggggttgtcagaaaagtgctcattagcagagactttctttgaagccctgtgctctcggccgctttgagagagaccatttccttatagaatcactcaacttgggttgagagttctgagcgagttaagtctcctgactatgcctaattttccgcccacagatttaacaaacacagactgcttccccagacttccttcgccaacttcccccgctttcttgccccacctctcagtgaatgctgaagggcatctgaaaggaaagaaaaaggagagggatttaaatcctccatgcaaaacctacaacaaattgtcagctgggttggagtaagaagctcctttgtcttctgtaaatatagagcttgctgctcacgatgataagtgctgaaaaaaatcccaggcactctgggaacctacataatgggaacaattttcctttacacttaactagcaggttgagaagccgtctcccctccaactactcacctgcactttttacactacttatttcccaacaatagtgttcttccagcgtccaaagattgctggtgatgaggtgtcacctgctaaacggcaggaaggtgtcaacgccattgtatttggggttgactttgacagggaaataggaggtgtcccctcaccatgcctgcttcccacacttcctctgtgaattcgtgaactttcaggcccctccgatggcagatggggaaaagctccaatggatgtctcccagtggggcctaattcaaagcagaaatatgcagtctcggagtggaaatgaccatcaatggatgaatggataaatcataggatagtcatactcgtggaatatgattcagctatgaaaaggaatggggtactgatacatgctacaacacacttatgtcaagtgaaagaagccagatacagaaggtcatatttgtatgactgtttatatgaaatacccagaagaggtcaatccttagagccagaatgaagactgttggttactagggactgggggtagtggggaatggggagtaagtgcttcttgggtacagagtttccttttagggtgatgaaaatgttttggacctaggtggaggtggtgggtgcacaacattgtaccctagattccactgaagtgttcactttaaagtggttcattttcacacctgtaatcccagcatttcaggaggctgaggtgagaggatagcttgagcttaggagtttgagaccagcctgggcaacatagtaagagcttgtcgctacagaaagaaaaataagtaaaataggccgggcacagtggctcatgcctgtaatcccagcactttgggaggccaaggcgggcggatcacctgaggtcaggagttgagaccagcctggccaacatggtgaaaccccgtctatactaaaagtacaaaaattagccggggcatggtggcacacacctgtagacccagctactcaggagactgaggcagaagaattgtttgaatccaggaggcagaggttgcagtgagccaagattgtgccattgcactccagcctggatgacagagcaagactccgcctcaaaaaaaaaattaaataaaatagccaggcatggtggcgtgtgcctgtggtcccagctactcaggaggctgaggtgggaggatcgcttgagcccaggagttcaaggctgtggtgagctatgatcgcaccactgcactccagcctgggcaacagagtgagaccccatctcaaaaaaaagggtttattttcagtgctatggattttacctaaattttttaaaaagaaagaaagaaagaatctccttgggtagtcacgttttgttagaccgctgagcccaggcttggtcttggtatgtgctgccatagcccgtgtgcccaatgcggtggggaagtcgcttcttgccatggtgtctgttgtgacatttctgactggaatcctgccgggtgatgtgacactgtggagtctaaaggtcccagatcaaatcccatccccaccacttcctggaacaagtcagttttttcctaaggtctcagtctgtaaaattggaacagcagttcttgccctactgacctcataagacaagcccgagaatgattctgtttcccaaagggcactgagagtgctctggaaggaacgcacacggtctggagatagctaaagatgaatattttttacttggaaattcagataggactttttgttagttcttgagtttgaattttatactgtcatcatctggttttggtgtccagataatactggcctcatcgaatgggttggaagtgttccctcctcattagtttcttgaagagattgtggagaattggtgctaattcttttggaatatttgatagcattctcccctggaaccatctagcccttgcagttcttttttgttttctgggaggcttttaattaggaattcaagtttgttgttgttgttgttgttgttgttgggttttctttgagacagagtctttctctgttgcccaggttggagtgcagtggcacaacctcagctcactgcaacctccacctcctgggttcaagctattctgcctcagcctgcggagtagctgggtctacaggcacccgccgccacactcagctaatttttgtatttttagttgagacagagtttcaccatgtttggccaggcttgtctcgaactcctgacctcaagtgatccacccaccttggcctcccaaagtgctggaattacacgcatgagccaccgtgccccgccagaattcaatgttttcgtaggggtagttatttcatcttgggtgagtttgggtagtttatggtcttcaaggaattgattcatttcattcgttgtcaaatttgtatgtgtacagctaaaaaacaaaattgaagtatctacttttatgatgactttcagtttgtagcatataatccataatcagaaacctacagtaggcaggaggatcactcgagtccaggagtttgagaccaccctggacaacatagatcctgtctctacaattaaaaataaaataaatctctctccccatgcatagcactgggtcagatcctttgcatgggtcatctccttggtcttcaacacgaacctgcaagctaaacatagtaatccccattcaacccagaaggacacaagctctgcccaagactaccacgctgggaagtggcagagaagggatcagacccagaactccaaaggccattctaaacccaactgagctgaccaaggccccaagttccctggcccagccctcaaacttgccctccaaccccagctccttcctcggccagacatcacactgagggcatctgcaggccacacctggcccttaaacatatcctttttattacttttaaaatttgttgccagcatttaaaatcaggatatttcacatacaaatccagctttctggtttcttttgaaaaatcagaagatctgggcatgctgcacccacaatcccaaatggcatcacttggctgcagctgcccagaaaccaccccctataaatggctcaggtgttcagtttgccacagtcccctcattccctatcatctccctaacattaatgtcatcatgtttcattttcttcataacatttgtcactctctgaaatgaaatgtttcttagttattttcttggttttttttttttttttttttttgagatggagtcttattctgtcgcctaggctggagtgcagtggcacgatctcagctcactgcaagctctgcctgctgggttcatgccattctcctgcctcagcctcccaagtagctgggtctacaggcacccgccaccgcacccggctaattttttttttgtattttttagtagagatggggtttcaccgtgttagccagggtggtctcgatctcctgacctcgtgatccacctatctcggcctcccaaagtgctgggattacaggcgtgtttcttagttttttatgcccttctctgccattagaatataagctccttgaggcaagggactttcaatatctgagagcaaggagacagcattgcaaagtggtcaagagcagaggtcagcaaactacatccatcctatgggccaaatctgctccctccccactcccccagcttgtttttttaaataaagttttattgtaacagtcacacccattcgtttacatcttgtctatgtctgcttttgtgctaccgcagcagagttgaatagttatgatggaaaccatatgggccacagagcctaaaatatatgctttccaaacctttatagaaaaagttcaccacccctggtctcaagagccagactactcagatccaaagacagctccacttcctagccatgtgacctcagacaagtcactttgccttcctgtgcctcagttttcacctctgtagcatggatgtaataacaataatactcaccttatagggtcactgggggaggattacatgagttaatacatgtcgagtgtttggagctgtacctcctatgtagtaaagagtttttgtagataagcaaatgacacttttttttttaattgacagataataattgtacacattcatggggtacatggtgatgtttcgatgcatataaagtataatgatcagatcagggtaattaacatatccaccatcgcaaacatttctcatttctttgtgttgggaatgtttaatatcctccttctagctatttgaaactatatattattattaaaatattgtcatgagtggggcaaggtcagatataaccaggtccacgcacgtttatgtctttccacaaggtcaggctttcactgatgctatttcagttatgaaagccactagctagaggaagacaagagaatgacctgtctggagttcccaaggaggcaattctccttaatattaccctttcacttggtagtcagggccatgagcacaaaaggctgaaaccactccacaagtcagtcaatattgcaaaccatacataatagtatacttaattgatatataaatgttatagattagaatttcatgccaaacagcaacattaggcatcaagaataaaggggatatgaaaagggactaacgggctgggtacggtggctcacgcctgtaatcccagcactttgggaggccgaggcaggcagatcacttgaggtcaagagttcaagaccagcctggccaacatggtgaaacccccgtctctactaaaaatacaaaaattagacagacctggtggcacacacctgtaatcccagctacttgggagactgaggcaggagaatcacttgaacccaagaggcagaggttgcagtgtgccaagtgcactccagcctgggtgacagagtgagattccatctcaaaaaaaaaaaaaggtgggggagtggggggcctaatgaaccagtccaaggagagtgacatgtagaaggagagagtcctgatccgggcacttgccagtatcttccaagagtcctttatttgggcagagccttcagcttcaaattctgggtgctgatgacaagtgacagtgagacagaatgtgttaagatgtcaagctggtgaggtcctgctcattttatgacccttgagtcctctggtgaggactggtggtaaagggttacacccttatctggttgggtgttgtctctattgattaggtagacatctggactcttgttgacttgatgacttttaaaatgtaagatggagtctttttctaagatggagtcacttatgtcaagggtgtgctatacatatagtatcttttaaagagctgcatctttagaagcacattgctggttatgtaagatgttctatctgaggaagtgtgctgaagtgtgacgactactaataataagcagaaagcacgtggtgttgatggggatgttgtcaatgctgatggcagcagcgggcacttgctgggcatcaaaccctgttctgagtccttggaatgactttccataaacaaacccatctcccatgtcaccacatgcccctcagccctgggcagtgactcctgttagggtgatcatctcatccaggtttgtctgtgactttcccacttgtagcactggaagtcccaagacccaggaaacccctcaatcccaggcaaatcaggagagttggtcactctactccatatccacaatccattttatctatttatttgttatttttgcctttaaatttatatcctagaaaaatactttaaaagctgctagacatgtccagctgaaagaacattcttcaaagattaaaaaaaaaaaaattctaagaggctgaatagttgcacaaaaccccaaaagaggaaccggtttcaacatctttctttgttctcttaaatttgaccatgatttcatcatttgtcatgagtttgactcttgtgattcagcgatgatggaatgtatcctacagtcttttggttaagttttttttttttttttttttttttgagacagagtcttgctctgttgcccaggctggagtgcagtggcactatctcggctcactgcaagctccacctcctgggttcacgccattctcctgccttagcctcccgagtagctgggactacaggcacctgccactatgcccggctaattttttttgtatttttagtagagatggggtttcactgtattagccaggatggtcttgatctcctgacctcgtgatccgcccgcctcggcctcccaaagtgctgggattacaggtgtgagccacctgcctggccagttaagttcttgttagtacagatagacccattatcttttctatttttggtgttctcccacaaaactgtcgaagaagccaagtttttttttaactttactgtttaaacatgtgaatcaacttattttttctttatcagcatcattttcttgtcttcctctaaaaaaaatttttttaaacaagctgatctgccttccaaaagtttccaagtaattaaacccaattaaaaccattaaattctttcttttaatgacaactttattattaaaagctaaccacaaggaggagatttaactggcaaagctctctgttgtgtgttaatccattcctgacctctggctgacacttccaagagataaaccccacagaatagggagctggtttaatgaacagctttaattaatacttttcttccttgtggcagagtaattatttgttcaacttgtaaacagctccttggcggtgattttttaaagacccagttggcttggatagtgtgatggttttgatgtgttttgtgtgtttgtgtgtgtttttttttctttaaaagagagaggggaggagatctccattccaggattggtgctgaagcacatgtgtcctgaagttcaggacgtcagggtaattgacacagaagaaaagtgaggcgaaggcaggcagcaagctgcctgtatttttgagacatctccagagagggcaggtctgcagacgggcaggtctgcactttgcagcaacagtctgcaagcccagacaaggcccccaaggagacacaagcccagcccaaatgcagtctgagtgttaagaaaggaaagggcctgggattgcaaagcgcgaggccaaacgcctcccccgaccttcccttcgcgtggcacctgagaaaggggcagcccagtgcaaatgctaggtgtgaccaaccaggccccggagaagcgattctgtgaacaaggatgactagcccgctagtagtgcttgccgcaagccgcccatgcatcccaagtgctttccacccatcacctccctaacctgtctcagggaggtagatgccgtgggttttcgtgaggttaagtggcctgtcccaagtcacgtaccttctagcaataagggcagagcgcagattgcagccagctgtctggctgcaggagtcagtcctaactactgggcagagctgccccttgagacaagaaagtggcacctcccactcagctggcggggagagacttaggtttgttttttttcatttagttcatctcttagttagaaagctggtttcattaacaagttagaaagttagtttcattgcccactctgtaattccaaagttaatttactaacactaaggaccaagctttttcattattttaaaaatcatttagaggagtgattctcaactaggggtgatcttgtccctcagaggacatttggtgacgtctggagacatttttgactgtcacaactgggtaggcgtgctactgaatttagtgggtagaggccacggatgctgctcaaattcctacaacccacaggatggaactacaacgtggaattatctggctcaaaatgccaacagtgccaaagcggaaaaaccctgatttgtagaatcctcaaatgtttcattcttatataattactcagacttttcattcttgtagaatgctcaaatgctcactctagaagcaatttgtaaacacacaaaagcaatattaatgcacccatcagtccccaccccaccccctcaaaattaggctgaatctcttataaaaaaaaaaagttaattaattaacttagtgaatttgttaaccaggccaccagaaattcttcagaaacacatctaaagtgccactaactgttctcaactgaacagttagttacggatgaaattgttagtacaagaatatttgaagacagtccccaaattcccaaacatctacctctacttattatgcaagtttccttaagaaaatgcttatgtggccaagctcggtggctcatgcttgtaatcccagcactttggaaggccgaggcgagaggatcacctgaggtcaggagttcgagaccagcctggccaacatggtgaaatcccatctctactaaaaataccaaaattagccagctgtagtggcacacacctgtaatcccagctactcaggaggctgaggcaggagaatcacttgaacccgggaagcagaggttacagtgagccaagataacaaaaaagaaaagaaaatatgtatgaagagcacaaagcagattaactaatttcaccctctgagcctccttgggctgagggatgtgttcagagatctctgatgcctctttggggctcccaagactctcctccccaagggctcagagctgtgtctgaagctggaaagataagcagacagtcctggagggcttaatcctgggactgggttgagtccaatgcttaagatgtcagaattcaagcttcttagagcaagggccgtaggcttcgtgtttctatctggaaggactgaccgtggcatcccacctgcaagacccttgacaagagcgaaacagacagctagcgttgctgacagaccaagacattattcagagagtgttgctgttttctgaaaattatctttggatatgttgcatttgataagattaatggatctaaagaggccctaaagttaatcttttcacaaacacacctgtttttgactcctagggtgacatcctagaaagacatgggctacaagtaagtgaggggaaaggctgggagcagagagagatggttctgagcccttcgggggcagctaaaatgagctgatttccaatcgcggccaaggtgtctggttcccgcagagccattcccggcctttggcaggcagcaaatggcagctgacaaggaagggattttccagttagctttgccttttcatatcaagtccaggaaattaaagacacacatactccacagcaataaggggagacggtttcccaccctgtgggctctccttttgtcccctccaaagaccagcattgcagttatcagagaggaaagccagcctgagacctgagaaaagaatcagggctgatttttaggtggcagctgcctgccgtttctcctcactttggaagtgtaattgtcattaaacatgttgtttgtttcattaaaagtagacatcaacagttacaaatcaggcatttacgaaaaaaaaaaaaatctggtggttatctgccctaagcttttttttcctaataaatcatttcattttatgttactagttcccatgaagatatatttatgagtaaaatggttaagattttggattcttgagttagacagtcctagatttgaatcccagctctgccacttattggcagcgtgaccttggacaagtcacttcatcagtctgagttttgatttatctgtaaaacagggaaaagatattttgaggaggaaatgggataatgtacacaaagttcacacatattcatatattcatttaaaataaaaaaatggccaggcacggtggctcatgcccataatcccagcattttgggaggccgaggtgggtggatcacttgaggccagaagtttgagacaagcctggccaacatggtgaaaccctgtcttcattaaaaaatacaaaaattagccgagcatggtggcatgtgcccatagtcccagctactcaggaggctgaggcaggagaatcacctgaacccaggaggcggaggttgcagtgagccaagatcatgccactgcactccagcctgggtaacacagcaagactcttgtctcaaaaaaagaaaataaattaaccaagcatctgccattcaagctctgatctaggtatgagggacacagtaatagctcccatggagtttgcctcctacttagaggagaagcacaaaaaattataaataaataaataagagcatttcagtcaatgataaatgctgtttaaaactgcaacagagtaatgggatgtggagtgagtggggaggagtatgttagtttatttcatagggaatggtcagagaagacctttctggcattgaaagtgggaatggaatgttacaaaggatccagccctgaaagagcctgggaagaggggatttcaggctgaggaacagcatgtgcaaaggccctgaggcaggagcaagtttggcagattcaaggcagagtggaagagtaggtggttactagagcacatgaggccactagaagacggtggctttactcagagggccaggggaagccagtgggttttaagtgaaaagcacagctctgatagttgttttaaaaagagcactctggctgctgtgtggacaacagacatgggggacaagggaggctagctgcctttatagtggcccagcacacagaggggctccttgtcttcctccctcaccgcccccctctcttggtgatggactgaaggtgccttggaaataagataaatgacaacatgcaaataaagtgctgagcgcaggagcaggtgcatagtagaccatccaaccagcaaagctctgataagaattattattttggggaactatctcttaatcccttgctccttggaaaacctggaagaaatcaggcaattggggtataaggaccaggtgaagtgctagagccctcaggtcaggggagcagttgtgccccccaccccagtcacatgcatgtccccctccaacccccaccacggatcagatcaaatgaggatggctagcatcagggtctgagtcactgccttagctgccagtttttcctaaagcagatttcaaccttgaaataaatctcttaaaatgccttttttatgatcccaaaatgaaaaccccaaataatatagctgaccactcactactttaaaaaaaatgaatgtagtatcctaactgtaacttaacggaaagaaataaaagaaggtttattttctttttttttttttttttttttgagacagagtcttgctctgtagcccaggtgggagtgcagtggcacaatctcggctcactgcaagctccgcctcccaggttcacgccattctcctgcctcagcctcccgagtagctgggactacaggcgcccgccatcacgccccgctaatttttttgtatttttagtagaggcagggtttcaccatgtcagccaggatggtctcgatctcctgacctcgtgatccacccgcctcggcctcccaaagtgctgggattacaagcgtgagccaccgcgcccggccgagaaggtttattttctaaaaatatgtatttcagtatgtaaatgctcaaacatgaccgcaatagaagacatgacaaaggagtctgatactaccacccacttctcatttaaaaggttgcatttcagagaactaggaagatctggggctcttctctactagaagtaaaggaaaatggaagaacagagatgggatggaccatgggatacaaacaagtatattcagtatttatcaaaaccatgcaaagcccgggcgaggtggctcatgcctataatcccaacactttgggaggccaaggtaggcagatcacctgaggtcaggagttcaagaccagcctggccaacatggtgaaaccccatctctactaaaaatacaagaattagccagtgtagtggcgggtgcctgtaatcccagctactcagggggctgaggcaggagaatcacttgagcccaggaggtggaggttgcagtgagctgagactgcgccattgcactccagcctgggctacaagagcgaaactccatctcaagaaaaaaaaaatcaaaaatactctatgtttacttctataaaggagttagattctaggctcagatcattagaaacaggtttttcacaacgtgagtgttcatcaggagatatgaaagtcacatgggttgtgggacaatttttctttctgtacaacttcctacagtgcattagaagacattaatatccttggcacccccaaataccactatccctctcaactattacaacgaacaaaatgcttcccccacaaatttccaaaccactgtctaggcggaggtgccacacctgccgagaaccactgccctaaaacagattcatggatgatatactcaaaataaccgcatttggcaattttataattgcatgctgtggtgggcagacaaatggcaccccaaagacgtccacatcctagtccccagaatctgtggctgttaaccttctatggccaaagggactttgcagctgtgattatgtgtccctaatgtaatcagaagggtttttataaaagggagggtggtcaaagtgggcggtaggagatgtgaggccagaagcaagatattggagtgacatgaggaaggggccatgagcccaggaatgcaggtggcctctagcagctaacacaagcaaggaaacagtcttctcctctgaagccttcaaaggaacgcagccctgcagacacctctcatctctagaactattagagaataagtgtacattgtttaaagccactaagtttgtgctaatgtgttatggcagccacgggaaactatattacatgtgtttatattcatggtgacttcccatttatggtgactacaccaggttttctatttatgatcatgataacaagtttctttctaaactaaaatgcacttagattttgtttttgtctttgaaacagggtctcactctgttgcccaggctggagtgcagtagcgcaatcatagttcactgtcacctcaacctcccaggcttgagcaatcctcctgctaggactgtaggcacacaccaccacgcccagctaattttttaattttttgtagagatgaagtcttactatgttgtccaagctggtcttcagttcctgggctcaagcgatcctcctgcctcagcctcccaaagcactagattatgagcgtgagccaccatgcccccagcgaggtgttttagaaggagggagtagccaaattaaaggaaaatattaagttaataataacacagctactctgtagcttggcagaacttgcaaaggtgttccaagaatggccctagtttggaaaataacaggttaaactatcgcatgggaatttctcagcgggagaagtcttctgttggaagcttctgaatgctgctgctttttgttagtaatacctaggcaccaggtgttttgcaagacacaccacacacaaatcctcaggagccctggaaaggactcactgcttatgttcagctgaagaaactgaggcccagggagagtgaacatctccttcaaggtgatgtacctggggaatggcagtcccaggatttgaacctgggtcctgccaactccatgggtgatgctctcaaccactttgcttcatggagattcttgtctatggccacattcatggataccttgtgaatgatggaggcaatttgtggtggccatttgggtgagtcccttgccccattaggcaatgcttgtataagggagaggttactcttttcagactacataataacccaggcccttccatggacttggcttaaatcaccttggggtgggggtagcaagaggtgccatcagaagagaagacagtctttccaaagtgcttcctggcaaagctcgaccattgctaagatgtaaagaaacacttgggcttgctcagcaggccttgtctatgccgcaaacacccgtttttgcttggaattggcacgttgcatgctgagttaagaatcttttgattataagcgacagaaattcaatgcacatcagcttaggccaaaaaggagaatttgttcatgtcaccaagatgtccaaacgtagacctaaagcaaggtgggatccagctccctaaatattttcatatgaatctgtgtgcactgtcaggaaggctctgcctgtagggtgacagagatggctgccggcatccttgagcctagatctaccagctcagccaccccaggaaaaaaaggtgcctctcccaggagtcatagctaaagtcctcaggccaatgcccattggctcataatcatccttgaatcaatcactatgattctagccagggatgggttatgagatcaccctgaaagacccataatgggtgttatttttactaaaaattattaactgctaatttacggatgtgactgctcattctcagagagattgggtatctccacaatagcatgctgcctcctttgctaaccggttgttttttgaaggtgtctaataaagacactgtgttgggaatccccaagaccaccttcggcctcaatgattgactagaactcacaaggctcagagaagctgttagactcacagttacagttattacagtaaaaggacacagattaaaatctgcaaggggaagaggcacatggggtgaaatccaggaaagaccaggcacaatcttccgggagtcctctcccaggggagcacggacactccacctaattctcccagcaacaatgtgtgcgaacacatgccaagtgttgccaaccagggaagcccacttgagccttgatgtccagggtcttattgggggtcagtgacataggcatgcgacacctaagtaactgacctcagccactcagacaccagcaccccagagcaaaaatagacattcaccataaactacattcttagcctaaactatctcaagtggaagtgcatggtgtggcccaagggcttggagctcatgcaccaggaactggccaagggccagccctgaagacagacatttcttaaggaatgtgcagggtttgagcaacccaggcctgctgagttaaccctttcctgcacagccagcctctaaatctttatagcagaccccaaatgaaatcagctaaatggctcttcccaagtaaagaccaccagatagcgtagatgtctggtgcacttggagattccacagaggggacagcacatcccttctgcccagtcatgcagctgagccatggaaggcagacgctccctcagagcaaaaaagccatgacaggggtggtggcctaaccagaggattatggagtctggagtcagattagacctgagttcagtgccaacactttctcttacaagctaagcaacattgaacaagctacacagtaataatagtaacagtaatagcaatataaacagtagctattattaagctaacatttattcagaccttgctatgttccaggcatggttttaagcacttaaacagtcattaatttattgtttttaattttttttacatggtcacagtaagaaatacattttacactataacccaccacatacacacacacacacaaacacacacacaccccaactggaataggtgttcaccattgctgtgtatgatagattctgatagttcgttgtctattgtaggaattaacaaacttttcctataaagggataataaatattttaggatttcagctaggtcctgtggtgactactcaactatgccattgtaccatgaaaacagccataaataaacattaagtgatcaaatgggcactgctaggttccaacaaaactttatttacaaaaacagacaacgggccgggtgcagtggctcacgcctgtaatcccagcactttgggaggctgaggcgggcggatcatgaggtcaggagatcaagaccatcctggctaacgtggtgaaaccccgtctctactaaaaatacaaaaaattagccgggcgtggtggcgggcacctgtagtcccagctacttgggaggctgaggcacaagaatggcgtgaacccaggaggcggagcttgcagtgagccgagatcacgccactgtactccagcctgggcgacagagcgagactccatatcaaaaaaaaaaaaaaaaaaaaaaacagacaacaggccatagttccatagtttgctgactcctgggttctattatatttcttccagtcttttttttaatgctgttcattaaactttcactaaaaggattataacctgcacttttacaaaaacgtatttaatctttacaacaatcctatcaggtatataagcccattttacagatgagaaactgagacacactgaagttaagtaacttgtaagaagtggaactggccttgatcagaggtagtctggcttagagcccaccttcttcacctgtacaacaaagcactcactagagattggccattatcattatcaacattattattaattattattattattattattcagccaggagttaagttatgaaggaactcatatttgaattatgaaggaactcaaaatcccacagtcacataaaccagtttcaggatgaaatcggcatgccttccttttgttcaaagggttgtacagctaattagtatgtaaatctcacttctttgaattgaacacattttagagtcatctattacaaaagtgctgcatgcttgaaacagaaagcttgcaaaatctgtaatctcagcactttgtgaggctgaggcaggaggatcacttgaggccaagaattcaataccagcctgggcaacataaggagaccctgtctctacaaaaaaaaaaaaaaaaaaaaaaacaaacaaacaaacaaaaaactaattaattaattaattagctaggtatggtggtgcaagcctataatcctagctactcaggaggctgaggtgtgaggatcaagaagatcaaggctgcagtgagctatggtcatgccactgcactccagcctgggtgacataggtagtagacctgtctcaaaaaagaaaagaaagaaacagaaaacttggaaaatccaggaaaaaaagtctttaatggatagagttctgattcattaaaacaattttttggtaaaaatctatatgtgttattttgaaatgagaacagttacctcctaatctatgtggactgggaagtagacttacaatacggcataaattggagagctgataaatttgaggatggtagagacacttgatagaaaacaactgtttagtcttaattaactatgaataactttggcattcacgttttgaaactcattcatgtttgctttacatcagattaattttattttaagaaagatttttgtatactcttatcctctccctttcatccaagaaatacaaccatacatcccaagatagtgatccacgaggcagatctttgggccgcctacgtggtgaaaggccccaccaacctcctataattcagagaactttgcctgtaattccagcactttgggaggctgaggcaagaggatcacttgaaccaaggagtttgagattaccctgggccacatagcaagaccctgtctctacacaaaataaaatataagccaggtgtgctagcacacgtctctagtcctagctacttgggaggctgaggcaggaggactgtttgagtccaggagttcaaggctgcattgagctatggtcacaccactgcaccccagcctgggtgacaggggagaccctgtctcaaaaaaaaaaaaaaaagaacttcatcaagaatgcataatagttatattactgagctgccatccaggtccatagcctctctcctgaagggcagttccaactcgaaacctcttcaccagcctcccacacaagtatgcagagcccaccacaccatcataaaaactgaacccggagaaatctgtagaacattagggcacgctaagaaaatctacagcgtctttgtctgatccgtaccttcgcctcaagagaaccacccacaagttctctagtcaaacaaagatgacattccatccacccccaccccttagcccccagcatggtccttcccaggatgagttacacattgaagcctgttttggaaaaactacctcctctcagttcattctggtttaaattgattttttttaaagtaatccacttatgctgttgcttgtttaggaaattaaccactgttgttttttgttttttaatccaaagaatatgtaatgcttcagaaaatgggtttcatgtaagtggcatgttaaaagcttttgtaccaactgatgtggggtcttcctgctgggttcgcagaaacgattctttgcttaaaggctcaaggaaggggactgggggattttgacaataaccaatgcttgtggagtgcctgctgcagtccaggcctgggctaggtgcttccacacgtgctgtctgatttaatcctcactgcaatgttaggtcttagagggatcaggctggacttgaaggggtcagtggcccgaaagagcatggtgtgaaagctgtctattttaggctttatttgactgggagaagttctgggtcagacagagggttgcctccaagctgtcctctgtgactaaagtcaagacaccaggatggaatatttatggtttatagtagggctgcattcagcaggcagcccaggatgaaactgatggcttttgtcttgtcctcactccagatgtatttcacataaattaatactgagtcaccaccaaatttttttttcttttagtttcttgctctctgcaaccctggaaaaacatttcctacttggataaactatgcagccataaaaaatgatgggttcatgtcctttgtagggacatggatgaaattggaaatcatcattctcagtaaactatcgcaagaacaaaaaactaaacagcgcgtattctcactcataggtgggaattgaacaatgagaacacatggacacaggaaggggaacatcacactctggggactgttgtggggtgtggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaactaaaaattaaaaaaaaaaaagtgttctgacccagggcaacactgtgttacttgactcctgagttagccttgcttttctgaggctattccagacttttctgcctctgtgcaactagtttttatcgtgttttttgaacagaggtaccacctacatagcttaaaacaatcttaggaaaatctgaaataataagaatgctccaagagtaggtgggtattctaaaggctcatcatataaacatttgggtgtcttcaatctttagaaaaatgtttaattacatgataagtatttgaatcccttctcttttaaaaaattctagaaggctgggcatggtggctcacgcctgtaatcctagcactttgggaggccgaggtgggtggatcgcttgagctcaggagtttgagaccagcctgggcaacatggtgaaacccctgtctctacaaaaaaaaatacaaaaaaattagccaggcgtggtggtgcacacctgtagtcccaattacttgggggctgaggcaggaggatcacttgaacctgggaggtcgaggctgcagtgagccaagattgtgccactctactctgggtgacaaagtgagaccctgtctcaaaaaaaaaaaaaatctagaatattctagataatactgaagttcactttgaccatcacttttaattcctgttccttcctctctgccttctagaagtaactgcctttctttttgtgtacagcctttcagatatgtataaatatgtaagtgcacatggaaaatatagtaacattttatgtgtctctaataaacggtaataacatacagtacatagtacataatgcaatcagaaaactttttttcactccagtgtattttttgatgtgtccctgttaatacatggagatctggtgcatttccttccattgaaatttcatttcccattgtatgaatagaccacatttcatttttcaagtctgctttgaagtgatagctaaattattcccaatcttttgctatttactaacaattctgtaatgaacatcttcgatatgtccccttgctcatgtgtatgagattttctgtaggatagataatgaaaagtggaattactgagtatgttgcctgttatttttaaattgttaatccaagaaatatatgcctatagtttaatattcatagttctacaaaggaatatatatggaaaacagcagtcctcagtgactgcccaccacccttttttcctgcccaggggcaacaactcttgctgctgcctttaaaaatgtaacctccaaattatttttattttattttatttttttggtacggagtttcactcttgttgcccaggctggagtgcagtggcacaatctcggctcaccacaacctcctcctcctgggttcaagcaattctgcctcagcctcccgaatagctgggattacaggcatgcgccaccacacccggctaatttttgtacttttagtggagacggggtttctccatgttggtcaggctggtctcgaactcctgacctcaaatgatctacccgcctcggcctcccaaagcactggattacaggtgtgagccactgcacccagcctcactcccaaatttctaagtaacatccttaggtgctacttcttgattctttttttccccccattgtaggcatgatctctggcttcccaaaatatactaattgagctctcttttctcacccttgaccccaacacacacatgcaaactttctcttcatgtcttcccagtatcagtcaatcataacttgagctttaccaatatgcggtatttgccttcttacaactatataaatactcttcacagagaagtcatttggtatgcaataattacttttccttctctgtgtgctggcctgggaggtgacaactttcagaataaatcctttcagcaaacaagtctgggtggcagctccttcttgcttcttgtccagtacatggagggttggtaatcagtgattaggtgcacgaattgctccgtcaaagaggagtgtgtgattgtgcagaggtgaaatgctttggatatgagtaatgcaaaaccttttcccaggtcacacacgattccctcctaggccctgagaagtttgttttcctcatttgctcttcatttttcactgagtaccctgccccatcgacttccagccaggaccaagagtgctaagctttggctctcggggccttgatgaagtgttttgcctaatggctgtgttcctgggcctgattcttcacagttgtgtgtgtgaagctgagatcaccagctgcatttttttctttctttttttttaagggtcaaaaagggtttatgtccttaattatttatttttataatagaaataatatagcctccagtgaaaaatttaaacaggaaaaggactgtatggagcaaggggacaaggcccctgtcgctcctctcccaactcagcccctttgagtcctcagaagcagtgttgttccagaaccagattacctatgttctaatctcagcatttgttagcttgtatggccttgaacaagttgcctaacctttgtatgcctccattttctcatctataaaatgggtgttttagtccatttagtgttgctataatagagtacctgaggctggataatttataaagaaaaggggtttatttgacttatgattctggggatcggcaagttcaagattgggtagctgtacctggtgagggcctcaagctgcttccattcatggtggaaagtggaaggggagtcaacgtgtgcaaagatcacatggggagagaggaagtcaactcttttaacaactcacactcttggaaactaatctattcctgagagactgagaattcactgactctcatgggaaggcattaatctattcatgacccaaacacctcctactaggccttacctcccaacactgccacattggagatcaaatttcaacacgagttgtgacaggaacaaaccaaatccaaaccatagcaatggaaaaataatagtgttcacctcacagagtttggtggggattaaatgagttaatacttataaagtggcacagagaaagcacttcatagatattagccaggaatattagccaggaatattattaacagtgtgttttatatcctcctagactagtggttcttaaccttgactgcatattgaaatctagactagtggttcttaaccttgactgcatattgaaatcacctggggagctttaaacttcttggtgcctggaccctgctgtcagcaattctgattttattggtctggagagcagcctgggcatcaggatttttaaaggcttctcagagcatcacaatatgtatccaggggtggaaaccattgtgctgcatattttccatgtgtatcggttaggataggtaagggcatgctgcagtaacaaacatccccaaaatctcatctacttctcatttatgatacatgtccattgtggtcagctgtatctctgatccacatcatctttattctggaacccaagccaacagaatatgtgtgggcattggtgaacatagctgccttccaggctaacagaataaatatccagaatacttgcagccttgtgaagtgagaaaagagagtgcatggggaagtgtgcactggctcctaaaaacttctgatcaaaagtgaaacataacttttgcccacatatcactggccaaagcaagttgcatggtccaatttctaagtaacatgcgtatgtgctccttcttgtagcacatacaagaagtatgttttttcagttgtaggtatgatctcttgcttcccaaaatagaagaattgagctctcttttctcacccttgaccccatcacacatatgcaaacgttctcttcatgtcctcccaatattaatcaatcataacctgaattgaacagggagggtatgtgtcagcggctggatggtaaatattttaggctttgtgggacacacagtctactcacctctgactttgtagtacagtgtagacaatacactgattttctaaaaaaatgtaaaaaccattcttaactcattagtcatacaaaaacaagcagcaggccaggtatggcgtgggggctgcagcttgccaacccctgctacatgtcctccttttgcagggagaagcacctcagggagggaccccaaatatgggtgaacagcagtacagtctaccacactgtgtatacagaaaggaggcactttcattgcacaagtgtgcaaattcatacgttatgctgtgttgcagcttgcttttgttacttagtactgtatctcttgatgacagtttcatatcagtaactccagaatgacttcgtttgtataatggctgcctagttttccctcctatgaatgtaccatagtgcctttgtgtttgtgtgtttttatcattaaccctctattgttggataacagggatttttttaaatatcaagaggagggagtaaggcagtgtgcctagagagattgttggagagagagactcaacatcccaactctcccagtagtttatactgaaatcttccagacctccctgaaaacaaaaatgtgttgggggcaacccctgaaaacatgcatttgccaggaggccctgttttattacagccatatcatatctgtgataagtgtccttgcaacgctgaacactgttgcaatcccagggtcattttccaggagatttaaatactggaaagggtaaaaagaaatggtgaaaactggaagtgagatcccggaagctgtacaacatgattatcacaccggcctcacacagagactcattttaggccacgcgtgagccgagcagatgaggaaaaaccaaaactgcttttcggcagtggaatgggaccaaaagggtagctaagattcctcaggctccgcgtgcatgtgattttccccttctctgcctcgcaggacaccacgacgtccgtgcgcattggccttatgatggaagagatgatcttcaaccttgcagatacacatctgttcttcaatgacctggaggtttgtggttgctgatttcatttaatatttgccatgtttaatcacctgcatctagtttatgggaagaaggatgctgcctttcctttctttttctttttctttttttctcctttttcttttagaagcttgaaacttttgctaacaacccccaaaaaggcccaaaactgtggccggtgatggtttattggaaacacacttagctcaattatctccctagctttcctgtgcagttaacgggctcttctctgttccagtggtagtgtccactggcagttttactaatccaataatggctatgtagtttcttcctcctgaaatttgctatttaataagtttattaaggcaaattagtacagatcctcctgggtcagtaataattagcagtggcccagggtggaagcttttaaaaacaatttacattcccctgaaagcatgttttataaagagaaagagtgagagtgagcagagggaatatgcttatttaaagtatctgctcctgagcccgtaagcaagatccaagggagatagggaaaaaagcgggagagcagcttcaaaaataaattgaattcatttgtttatacccagcctatgtcagaaaggatttcgaatgggaaacatatttagaatagaactagtaacacaaaggcaagcggaagcaaagctatgtcatgaataagggtaagacattgcacaaaaaaaatccaggctcaggctaactattgcaatcaagttcagagtgtatcacttcctggtagccaaagtaaagagggaaatacaatgagttacttctctctaatgaaagagcaagcaactttctccaacgtgaagaaggggttttggctgataaaaggatcagtaaggaaatcttctggctttgtaaattatgttcaccttattggttcaacagattgaaaagtaaaggcaaccggccgggcgcggtggctcacgcctgtaatcccagcactttgggaggccgaggcgggtggatcacaaggtcaggagatcgagaccatcctggctaacatggcgaaaccccgtctctactaaaaatacaaaaattagccgggcatggtggcgggcacctttagtcccagctacgcaggaggctgaggcaggagagtagcgtgaacccggaaggcggaccttgcggtgagcagagatcgtgccactgcactccagcctggcaacagagcaagacaccatcaaaaaaaaaaaaaaagaaagaaaaagaaaggcaatctaaaataaaactgtatacaaaaaaacaattctatttctcttagtaggaatattttttcccggaatctggaatatccctggggactaaactgaagtagaaatataaaggttatggatttcaaatccatcctggctagcccaaggcactactaatatttatcattaggaaagcatacagatttttctttctagtctgcaggctggagttccagagagaggaatccttgctgaaataatcagtcttgtgttttgtctaatctatgtaagcctcttgggcctcagtcttcacatctataaaatggaattggtattctttgcccaacatctgtttcaaagagcagaactaggtagaaacttgaggaagaaagagagctttggagcaatggagaataaataccattggcttcaaggcttgggactgtctctattcaaaagcaaagttcaggctcgcttcacgatgacgtctatggctcgaaggacacaagagagaaaacaaacaaacaaaaactgtggccgttgaattcagtgagtatttatggagcctaatgcggtaaagactcagccgattgcaaagatcaaaacccaactcgttttaaccaaaagtggaaattattggcccttgtagttgaaaagtccagggttgttttcattcttgcttattgcccccacttctgtgagaacagggaccactctgtgtgattgaccctgaatctctagggcccaggcagtaaacaaccaaacaaatccataaacaagaccatttatgataataaaaaggatatgaagaaaataaaataatcagatgtgagaacaagtgatggggatggaggagggttggggggcagcattcttgagggggccggtccagggaaggcctcttaaggcagtagcacttgaaccaaaggatgacaagcacccattcagatggagatcgggggcagtggggcggggacagcaagtgcaaaggtcctgagtgagaacaagcatgaaggcccctgggatcagagagaaggcatggaggccgaagtgcaggagtaaaagtatggaggtggccaggatagatgagcctggggcaggagatattacagcaatcgaagctcattctaagtgccttggacatctctggggcaagctgatattaagaaggaaaagccacatggtctgggttgtgtgttaaaaagacctctctggctgctgtgtggagaatgggcagtcagaggagaaatgtggtctgggcatggtggctcacacctgtaatcccagcactttgggaggccaaggcgggtggatcacttgagatcaggagttcaagaccagcctggccaacatgatgaaaccctgtctctactaaaaatacaaaaatattagccaggtgtggtggcgggtgcctgtaatcccagctactcaggaagctgaggcaggagaatcacttgaacccaggaggcagaggttgcagtgagctgagatcaagccactgtattccagcctgggcgacagattgaaactccatcttaaaaaaaaaaaaagtaaaaaagaaaagaaatgtggaggcagagagaccagccaagaggctactgcaatagtccaagcaagagaagaaaatggactggatccaggtggtaggaagacgtggacttgagggtgaggtgaagccaagaggacttgctgatagactagatgtggaggttgggggagagagaggtggcaaggactcctgggcttgatctgaccaggatgtgttgtccttcactgagatgggcaaaacagaagaggtgtttggtatgcagtggaggatcccatccccctgtctggggtacgtggggtttgagatgtctgagacaccctggtgaagatgccagatcaggcagcagatagatgagtttgaacctccactgcagtaacaacaccaggcatggaataggcgccttgtggatcttggttgaacctgcgactcaaagccaggtattttgtgggatttctgtgtatttcaagctgatgtcttcagagtcttgccccactctgctgtttctgtctggcccctgaagtcgaagttgcacctctggaaggaggatcttaattaccagctggagctacttagggaagccagtttgtttttattttctaaatttatttcgaaaatgtcccagtgccagaagccccccagggcacctcagcagaattgaaaccacgttatacgatgatgaagttaaaatccacacaagtgaaaacatattgtttgttggtgcaaggcagtccctgtcaaaatctaaagcacagccttctgcagctgcccagggaagctgtgtggaccagagagaggcgtgctcaaggcccggcaaagccagaagcctttgttctccgagcctgtagtagtaccacctgtaagggagttccttcccgcgtccagcagcgctttatgaagggcttaccatttgccaggccctaatggaatgctgtggattcagcagcaaaccaaacacagcaagacccgtgcccacaaggcattgaccttccagttcaggaggctgaccataaacaatggaatgcaaagtataatgtcagagcaaagtgctctgaagagagaccaagagagtcagggaggaggctctcaccagggcttttgttttgtggtttttacttgttatatccaggagaggctcctctgactttttttttttttttttttttgagacagtctcactctgttgtccaggctggaggtacgatcttgtcgcactgcaacctctgcctcctgggttcaagcgattctcctgcctcagcctcccaagtagttgagattacaggcacacgccaccatgtccagctaatttttgtatttttagtagaaacagggcttcaccttgttgggcacggtggtctcgaactcctgacctcaagtgatccaccctcctcaacccccaaaataccaaagtactgggattacaggtgtgagccaccgcacccaggctcttctgacttttgagcaaagacctgaaggaggtggaggaggaggccatgccgatatctgggtgaagagtgttccagatagaagcactgtgcaaaggccaaggtatgattagagttgatgggctccagaaactgggaggaaaccagcaagactgaagcagagggaacaggaagaattgtggtgggcaatgagggtgacgcctttgggccattgtaaggctttgggtaacagccaagggtgacaaaagccactggagggtttggaacaacatgatgtgactttggttcagaagctgcctctggctgcctggtggagaacagactccagaggacaaggattgaagcaggcatccgcattaaatcagcaacttccagactcccaggggaaagaatctgtggggtttaaagaatggtccaggattggcctggtgcggtggctcacgcctgtagtcctaacactttgggaggccgaggcgggtggatcacttgaggtcaggagttcaagaccagcctggccaacatggtgaaaccccgtctttactaaaaatacaaaaattagccaggtgtggtagcaggcgcctgtaatcccagctacccaggaggctggggcaggagaatcactggaacccaggaggcggaagctgcagtgagcagagatcgccccactgtactccagcctgggcgacagagcaagactctgtctcaaaaaaaaaaaaaaagaataaaaaaaaatggtccgggacacagaaggtgccacatgcagctgtatcttaggatattctgcacgcatgtcccaagttgaggacaaaagccttctaatcagttccatctgctgttgagtcctggatccaccatctcctaacctgggcaagtctctccatccctctgagcctcagtttgctcatctgttaaatgggtggaagaaaagcccccaccatctagggctgtaaggatggagctatgtgaaagcagtcagcacagagcctggcatacctgcccaatgtgggggcctttccaccagggggctacaggggctacatgtgtccctggggataggcaagtgggggttctatggtaccagggcaaattgtttaattgctacatatttattttactgtgaattagaaaactataactagcttgccgacccctgattttacaatcattttataaaagtataggcaacagaaatatgacaaagatgatgacagtcatgagcagaccaggcctgggtcccagccaactgctgcagcttgggcataaatatcgacactccctcccctgctccctgccactttgcctttgtgcaagagctgctgattttgcagctcttactttgcagggcaggtgaaccctcctctgaaatgtcacctgggtcatgggtaagggtggatgttgggttaaaattcaagcacctgctcaagatctgtcaaaactgtcctccagccccactctactgcactcactctgaaagctgttcatgggaagcccccaagccctacttcacagggatgtgccactgtcgagtcagagctggacctaggtctgcggcctctgtcccagccaagcagggaccccttaggttttgacttctgggctcggatgcagccaggaggagatactgttcagccctgccctgtgagaagaagagattggggaggcctggcagccgagactgtgctactgcactccagcctgggcgatagagggagactccatctccaaaaaacaaaaaaaaaaaacaagtattatttatgttttgagatgtcacaactttaatttaaaatacatttaaaacctagatttatgttgaatggctgaaattttataggcagtgtgattaaagatgattccaaatttcagcaaggggacatttagttcgggcatgaaaaagaagttaacaagcaaaggtacctataaacaaaggcatcataaatagatataaagccagaagaaaagggatctaaagtagacagagaagataggctgactctccagttgcagattttcattatcagctcatcacaccaccgaaactctctggtgatttgctatccacatccatggcgtttggtggccctaaagattgtaacggcccccatcctcttggttaaaatggcaggtgtgttgacaagaactgtcttaggtaccccctgcctgctgggcatcacattcttcttggtatatattaaaagaacacaagtttgggccaggcacgatggctcatgcctgtaatcccagcactttgggaggctgagacagtggatcatttgcggtcaggagttcaagaccagcctcgccaacatggcaaaaccccatctctactaaaaatacaaaaaaaaaaaaaaaaaaaaaaattagccaagcagggtggcgtgcacctgtaatctcagttacttgggaggctgaggcagcagaaaccaggaggcggaggttgcagtgagccgagatcacaccactgcagtccagactgggcaacagagcaagacttcatctcaaaataagtaaataaatacatacatacacacatacacacacgcaagatttgcaggcaagatgcagcaggactgaggagggggccttccttgctctcccttgccttagcaggcaatctgtcaatgtcagggtgtcctctggaagccaggaggtgtgcctgagtgaggtgctgtccctgaagaagatgtccaggggctggcatggtgagggcagtagtaagagggaggcaaagagtttggccccaggagggtggaattaatgcatctggccagggagtcaatggtcgcacagcagtggctgaggttggaggcacctggcgtcatcctgcctcacctgagtttctgctgcattctctggtcctggcccctgtccgcttctcttcactccccttgccattacctctgtggtctaagtcaccatcatctttctcttggacgtcatcacggccttctcactgtccccctgctgtctatgaattaggatacaagctcatcaaaataaagaggcttaagtacaacacagatctgtttctctctcatgaggaaatctgaaatgtgaacagtctagggccagaaaggcagctcttccatgccagaagcccaggcacagcggcttccttttcccccaccccccgaaagacagggtcttactctgtcacccaagctggagtgcagtggcatggtcatggctcactgcagcctcgacctcctgggctcaagccatcctcccacctcagcctcctgagtagctgggactataggcaggcgtcaccatgctccgctaatatttttattttctgtagagatggagtctcctatgctacccaggctggtctcaaattcgtagtctcaaggaatcctcctgccttgggctctcaaactgctgggattacaggcatgagccacctattccaggcacattccaggcagcagggaaaaggaggcagagacagagaagggcaccacccagcggttgcagttctctcttctgctcacaccccattggccttaacatagtcacttggccacaccttccaaggcaagggagcctgggaaatgtagtctttattctggacagtcacgtgccaataaaaactgctactaataaagggggaagtgaattgggtattgagggtcagctggcagtctcatcctgacacctttcctcggttttcatcacagtagccagagaggtgaaaaggaaagctgaacatgtcacctgcttaaaactcttcagtaggctgggcacagttgtttgcgcctgtaatcccagcactttggaaggtcgaagcaggtgtatcacttgaggtcaggagttcatgaccagcctggccaacatggcaaaagcctgtctctactaaaaatacaaaaactagcaggtcatcgtggtgggcacctgtaatcccagctactcggtaggctgaggcaggagaatcgcttgaaaccaggaggcagaggttgcagtgaggcaagatcacacctctgcactccagcctgggcaacagagcgagactccatctcaaaaaaaaaaagctcttcagtgagctattatggactgaccccacctgcctctccagactctttttctcctactcttttcatcatttgctccactccagatccaatggtctttttttaattccttgaacatccatgctccccactaccttaagattctgcccacgccatgccctctgtatggaacacgcttccccaccattctcccctcctcttgttctcaaggtccaaggcctcgccagttcctatgcacctcttaaatctctgaaccagttccatgtccttagggaagtcttacccgattcccctcaaaaggttagattctgccatcatatgctcccaggacgcctcatacttatgcggtacattttgtactctttgtaaccatttcataattatttaaagtaattgatgtgaattctgtgttccccaccagctgtgtattccaggagggcagagaacatgtccactgtgttcactgctataactggcacatagtaggtgatcagtaaatcgttgtttcttgacggttgatgatcttgccctacgaccccatccatggtaacaactgccttctggaatttctaactttcaggaaactgactttgtttatgtgcctttgactttattagaaattaagtaggttaacgtcgtccatacaaaacaggatgtatttctcttatctgcagaactctagaggttagcaatccagggacctcttctcgacgaagagctcagattcctgccagcacttaattctcacctcctattttacagacctcaatttccatttactgcattttcttctcctcaaatcctggtttctggttctgcaacctcagccgggtgcctggactctgacccattctcctcatttgctagatcctctagtctggcatgtttgccctggattattcctccacgctgtacacatacctcctaccacctgtattgtgaattaccagccctgctccttagcagtgtcatttgtgtgttgggaggacaggggagtgtacctttttttttttttttctcaaagagtgggcattctgaatgttctcattcacattagtgtcagtgtgtttaactagaccagcattcccacctgagggcagccccatcccttggatggataggggggcgcattagaaactaggggtggggccaggcatggtggctcacgccagtaatcccagcactttgggaggctgaggtggcagatcacttgaggtcagggcttcgagaccagcctggccaacatggtgaaaccccgtctctactaataatacaaaaattagatgggtgtggcagcgggtgcctgtaatcccagctactcaggaggctgaggcacgagaatcactcgaacccaggaggcaatggtcgcggtgagccgagatcgcgccactgcacttcagcctgggtgatggagcaagactcagtctcaaaaaaaaaaaaagaaagaaaagaaaaaaagaaactgggggtgggtgggaggcagagattgcattgagccaaaatcacaccacttcactccagcctgggtgacacagttgagactctgtctcaaaagaaaaaaaaaagaaagaaactgggggttggggtagttggttgtcacatgaagggaaagcactgtttgcttttagaggccgggccagcaataccactcaacccaatatgttggacagtcttgtacaaagtggaattgtcccacccaaatgcccaccacactgagtccctgagagatgtcagtcagctgagcagtatttatggatgccttgtgcacagcatgatccaggtttcatgtggtttgctcttaattaaaatacaaaacaaaacaaaacaaaaaaccactttgttaaatgtatggctttttcttactcgtgttttaggggaaaaatgaccagtacatcaaaccagtgatgtcataggtaatgatgcccaggatgaagcgtaggtttgtgaaagagcatcagtgtaaagataaatgaggaggccaagcgcagtggctcatgcctgtaatcctagcacttttggaggctgaggcgggaggatcacttgagcacaggagtttgagaccagcctgggcaacatgacaaaaccccatatcttcaaaaaatacaaaaaaaaacaaaacaaaattagccgggcatggtgatgagtgcctatagtcccagctacttgggaggctgaggtagaggatcaattgagcctgggaggttgaagctgcagtgagctagctgtgatcacaccattgcacttcagcctgggtgacagagcaagaatatctcagaaaaaaaaaagactgagaagttagtgaaagtggggactcctctatggctaaatccgtgaaggtgcgacatgaaggagcatggctgtatccgggtgagtgccatccactaagaggcctggcaccgtggaaggaatgggatactatttgggatcagaggacctaagttccaattctgaccttgattcttctgagctctaagaccttgaaggaggtatttaacttggctgactttccacttcttcgtctgaaccagatctcaataataactgacatttactgagcactcactacataccaggcactgttctagctggcttgtatgtttcactttatttaatcctattatgatccccattatactagtctgctcagtctgtcctaataaaataccatggagcgggtggcttacacgacagaaattttctttctcccagttctgcaggctggaagtccatgatccaggtgctggcaaagttggtttctggtgagggccctcttcttggcttgcagatggctgcatttttgctgtgtcttcacccggcctttcctcaatgcatgtacatggagagagagccagagagagaaaacagctgtctggtgtctcctctaacaaggacaccaatcccattgggttagggccccaccctgtgacctcacttaaacttaattacttccttagaggccctacctctaaatacagccacatagggaggttagattttcaacatatgaattttgggaggagacacaaacgttcagttcataacatccattttacaaatgaggaaactgaggcagagagtggctaagtgaacagcccaagtcacatagttggcagtggcaatattcagacccaggtggcctggctccagagaccctgcccttacccatggtgctgtgttgcccctgccagggacagtgatgtccgtctggtttgagaaaaaggattcccagtaagaatttaggagctcgtgcagtgccgcagacagtggactcaaaggaagaaaagaaagtgcaagggaggctggagtcactgagaagtgtggtggcggaaagccaagatctgacaccaggaggaggaggaagtcccaatgttcatggagaaaacaaatatttttcatctctttgggtttttctgattttgtttttgtttattttgttttgtgtgtgtgtgtgtgtgtgtgtgtgtgtgtgtgtgtgtgttttgagatggagcctcgctctgtctctcaggctggagtgcagtgctgcgatctcagctcactgcaaccttcacctccctggttcaagcaattctcatgcctcagcctcccgagtagttgggaccaccagctgatagctcctaaagccaccacacctggctaattcttgtatttttagtagagacagggtttcaccatgttggtcaggctggtctcaaactcccgacctcaagtgatccacccacttcagcctcccaaagtgctgggattacaggcgtgagccgccgcacctggccaagatttttcatgtctttgtaagatgaaaaatcgaattattagattcctctgctgtgagtttgcatagcaccttatgcaaagtaaaactcacacaaatagcaacaagcaaccacatgaacacgacagcatccttcactccccgctgaggggatgaatcgcctggaggtgatcaaagcaatgtgcaagggatctgaatgcaccttctagaaaagacatgttactcccacatgctgagtgcacatgtgggagtaacaagcacaatcccgatgggagctagtgtgtcctgcatgcgactgtgtgcctggcagtgactgaagggcttgtctgtacccattcattaacccttacaacaaccacagagggcaggtactgttatgtatccccatgttagagatggggaaactgaggcacagagcggttcacttgtgcgacagctgacgcatatcaagctcttcttttgcaccaggcattgcgcatgaaccatctcaccgcatcctcacagcagccctgcaaaggagatggttttttcaatctccattttacagatgaggaaactgaggcccagaaagatccctttcccagggtcacacagctagtaagaagaatgtggagatttgatcccaggccaaatgacttctctgctaatgtctatctttcatggagaatagagtttgagatgaactaggaagtggagaacatgcatcaactgaatggatggaagaaaagagtctttcagggggccagccatggtggctcatgcctgtaatcccagcactttgggagaccaaggtgggcaggtcacttgaggtcaggagttcaagaccagcccagccaatgtggcgaaatcccgtctctacttaaatatatatatatatacatacacacacacacacacatatatatacatacacacacacacacatatatatacatacacacacacacacacacacacacacacacacacacacatatatatatatatatatatatatatatatatatatatatatatatatatatatatattagccgggcatggtggtgcatgcctgtagtcccagctactcgggaggctaaggcaggagaattgcctgagcccgggagacagaggttgcagtgagccaagatagcaccactgcactccagcctgggcaacagagcaagactccatctcaaaaaataaaaaaataaggaaagagcctttcaggagaaacaaggtaacgctaaagatctttggcaaaaggtatccctagcctgacgcaggaatggccaggcattcgggcaggctggaaggggagcatttcaagatgcagccagggctttaggaaagaccatgccggagagactcagaagttgctgaaatcagggcagccatggctgcttgcctgacacatgagcctggttgctaaacgtgtgatttatcctgatagctttaggagccatcaggaaaataatatgtcactgtgttaacactgaactctctccaaagcatcctgcccaatggtcattaatacaattcaggccacagcctctttagcgctcttaagataagttaaacacttagcacaagagatgtggcccaggtttccctcccagggagtagactcctctctggctagtctggaggcagcattaagcaatctcacttgaaaaatatacctgcctcagaggagaaggagcagccaggaagttcatcggggccctgatgagcatcatttttctaacgcaaatttgtcaacaatttctgcattcatgtctccaagcagccaaagacaaaaagtaatggaatcaaaccacagcaggagagtttgagaaaccccagctgtcaccagctcaatcagaacaggttttgataagtatttgtcactgagtttactgatcagcaacgtgcaacaacagtaatactaagtatcggctggggatggtggctcatgcctgtaattccagcattttgggaagctgaggagggcagatcacttgaggtcaggagttcgagaccagactggccaagatggtgaaacctcatctctactaaaaatacaaaaattagccaggcatagtggtgcacgctgtagtcccagctactcaggaggctgaggcagaacaatcacttgaacccaggaggcggaggttgcagtgagccgagattgcacaactgcactccagccttggtgacagagcaagactccgtctcaaaaaaaaaaaaaaaaaaaaaaaaaaagagtactaagtatcatacctgtgggatgcagaagggcagtccagattggcatttacagtcctaaatgacatttgttagaaaaacaggaaaattcataagaataattggaaagaccgttaaaatagataaggctttagcaagcttaatcaaaggggaaaagagagagatcaataaacaacatccagaatgaaagggtggacattactaaaatccaggggaggttgtttcttttaattacaagaatgccaggcacactgttttaccaatgaatttgaaaatctaggtgagattgacacttttcaggaagacacaaattactgaaattagcccaagtggaaataaaaataaatacaacaaaccaaagatcatgaaaatttgttaaatcattaaagagaaagtgcgtttttggtgcccccaccaaaaaaggcaccaggtcccactggttttaaacaagagttccaacaaaacttcaaggaaaggataaatctcatccagcataaactacagagcaaagaaaaagatggaatgctctcccacacattttataagactaacatcaccctaaagctgacactggagttacagcgcatatgacaaatggacaaattgcggtcgtcgctgctgaagttggaaggcccctgcgatcccagcacctaccttcatccatgccctgtgactctttacagaagttttctgcagatcctgtctgagctttagtttccacactggtgaaaagaggggtctggactataattggtatcatttatttgacacctgccccttgcctcgtaacacacctgcaagcagatagaataaccatattttgtaattttttaaaaaacactgaagactgtctgggtgcagtggctcacgcctgtaatttcagcactttggaaggcccaggtgggtgggattacctgaggtcaggagtttgagaccagcctggtcaacatgatgaaaccccatctctactaaaaatacaaaaaattagccagatgtggtggcaggcatttgtaatgccggctacttgggagactgaggcaggagaatcgcttgaacccaggagatggaggttgcagtgagccgagatcaccccactgcactccagcctgggtgacaagagtgaaactctgtctcaaaaaaaaaaaaaggaaactgaagaccttgctgtgttacctgagcccaggaacgatgacacccttgtagcaatgaggatactcagataacagtttctaataccacgctgcaagaaaaaggaaccagagctccatggagaaatggctgattctagggctgggccaagaactatatgattatcccagagcatcttttagcaccgtaaagtaaggaattgctcaggaaaacccaaagtgatacgttatgccagaggaacacaggatccaactgaaaagagttcccaatggccaaatccagaaagataaaaagaacaacaaaataaaacaaaagctggagtaataaaataaataatataatatcagatcccaatggccaaatctggaacaataaataaaaaggagagcaaaataaaataaaagctggaataataaaataaataatgtaatatcagattctaacccaaagtataaaataagtatgtatgagtctatgctgatgtagataaatgattgcataaataaataagtggggagactaaacaaatctcccacacagaaaaattccaggtaacttatgtagatactacacccatagtgtgagccacgcatagtgacttctttccaaagagtacaatatagatgaggggaatagtaacttcggagtggagaaccctgatgaagaccacctgagccaggtgatcaaggtcaacatcaacagtgattagtcatgttgataatatttacccttgatgtgatatgaagagaatggcactccccatctgtgaccttcccaaaacccaggaacccggtgtcatcatgagaaaaacatcggaaaaatcccagttgacaaacattttacaaaatacctgaccagttctccttcacaccgtcctcaaaagcaaggaaagcctgagaaactgtcacaaaccagagaagcctaaggagacaggacaactacgtgtcatgtgatatccaccttggatcctgaaacagtccaagaacagtacagggaaagccttaaaaatctgaataagtaattgacagtagttaacacagcactatctgcttattagttttgacaaatgcagcatactaatgtaagaagttaacaaaaggagaaagtgggtgtggggtgtatgggaactctctgtactatctttgcaacttttctgtaaatctaaaactattccaggccagccacggtggctcatgcctggaatcccagcactttgggaggccaaggtgggcggatcacttgtggtcaggagttcgagaccagtctggccaacatggtgaaaccctgtctctactaaaaatacaaaaattagccaggcatggtggcgcatgcctgtaatcccagctacttgggaggctgaggcaggagaatcactgacctgagaggcggaggctgcagtgagctgcaggaagccactgtgtgggcagtgtagtgaggagagggtaggagatgaggtcagggaggtgatgaacctgagggtgggcagaccacatggagccaggttccactgtgaggactgtgcttttatttggagggaggtgatatccattgtggggatttgagcaggagcgggacgtgatctgacttagggttgaacaggatccctctggctgctggctggagactaggctgggaggataggggctagataaggataggagcaggaagagtgaggaggtgactgtagtagcctacaccaggggtcaacaaacttctgtaaaggaccagagagtaaatatttttggctttgcacatcatagtggacctgtctcagctactcagttctcctgcagtagcacaaaagctgcagcagacaggatgtaattgcatgaacatagatgtgttctaataaaactttatttacacaaacaggcgacaggccagatttggcccctgggttatagcttactaacctctgatctaggtgggagatgatggtggtttggaccacggtggggcggggggcggtgcgggcagtggaggaggtgagaatggtcagattgtgggtatatgtcgaagggaaagccaacaggatttggtgatggatgggtggcaggatgtcagagagaggagacggggataactccaagacacatgcagtgcctaggccagtgttgggaacatagaaggtgatcagtgtgtacgcatcttgaatcagcaatttggtatttcatgcctctttgccttgtcttttccagtgacatgataggcactgtgagggcaagagccagatttcatccttgaagcctcccctctctttttttttttcaagcttaattcactttatttttcttgtataaaaaccctacgttgtagccacagctggagcctgagtcctctgcacagagactctgatggggtcttgacaaggtagtcagtgaattcctgacctgaattcctgaattctagggagacttggtgaatacagtctccttccagaggttgggggtcgggtagctgtaggtcttagagatagcatcaaaggtggccttggtgaagtttcccagggtggcagtgcagctgcggcgtagcagtcatagatacccgccatcagcagcagcttttgggcatggggactgagacgatgccagtgcccctgggtgcagggatgaagtgcaccagcacagagccacagtggcctgtcaccttacaagggacggtgtggggcttgccgatcttgctcccccagtagcctctgcacatggggacaatggagagctagcccaggatgatggccccgcggatggcgtggccacctccttggagcacttaacacccagaccgacataccattatagtcaccgatgacaataaatcccttgagcctggtgcgctggctggcgtgggtctgcttttgtactggcatgatcttcaaaacctcatccttgagagaagcccccaggaaaaagtcaatgatctcaaactctttgatggccaggaagaagagatagatctcctccaggaacttgatcttcatgtccttgaccaggtggcccagcttggggatagacgtccactccttgtccttggtcttgcctctgtgagctcctcggccttggcccgggccctgtccgcggctatgaccccagccccggatgcccctgctgaagcctccacggaagccaccgtggttccccatcccagggtccccagggcctccagccccccatcccccaaaaccggatgttttcttggagaagaaagaagcttcccctctcttgacccatcaatgtctgatgcggtgccgggcccatagtaggtgtttttatagtcttgggatagacagatcttctcgagcacaggctctgaaaggagatgggtccgggtgctggctcctcttcccctcgccttgggcacatctgagtttgcttgagctgccattacaaagtcccacagactgggtgccttaaacaagagaaacttactgtcccacagttcatgagacgagaagtccaagatcaaggttggttccttctgagggctgcaagggagaatcttttccttgcctttctcctagctcctggtggtctcggatgtcctctgactcgtagagaacatgtcacccggtctctgtcctcgtcatcacctggcattcttcgtcttctgtctctgtgtccaaataccccctttataaggacacagacatattggatgaaggcccacgctaaggtcctcatcttaatgtgatcatctgcaaagaccctatttccaaataaggtcacattcaacatcttgtaggggacacagttcaacccataacaggcatgttcctacactcctctctgcctcgttttctcctagtttcccactacatatatagaaagtgctggccatagtccctggcacattgaaagcttttaataaatactagtttctatccctagtccaatactagtttctgtccagtgatagagatttttgtctctatctcactgagatatttgtaattaatttttttcaaaagcagtacatacacacattatcctttttttttttttttttttgagacacagtctcgccctgtcacccaggctgaagtacagtggtgcgatcataactcactccagcctcgacctccccaggcttaggtgatcctcccacctcagcctcccaagtagctacaactgtaggtacatgtcgctacacctggctaatttttgtatttttggtagaaacagagtctcaccatgttgtccaggctggtctcaaactcttgggctcaggagatgcaccctctttggcctcccaaagtgttaggattataggtgtgagccaccacacctggccctcattttttttaatgaaagtatttcaataagctaaaaccttctttgatcaccagcccaatcccagtgactccccatatgaaactgctgcttccagccagatgtatgggcttccagatctttctttttccagttatgtacaatatatccatataaaaatctcatattttaatgggattttataaatatatacatggcatcatactgggtgtatcactcttttttttttttaaacagagtcttgctctgtcacccaggctggagtgcagtggcgccatctcagctcactgtaacctccacctcctgggctcaagcgatcctcctttctcagcctcccaagtagctgggattacaggtgtatgccaccatgcctggctaactttttgtatttttaatagagacagggtttcactatgttggccaggctggtctccaactcctgacctcaagctatctgcccaccttggcctcccaaagtgctgggattacagatgtaagccaccgcgcccagccggatgtatgattctttaacctgcgtttttcacactccaggatgtcttggaaccatttccatgtgctagcataaaaattcacctccttggcttgggacgtggctcacgcctgtaatccccgcactttgggagtccgaggcaggggggtcatctgaggtcgggagttcaagaccggcctgaccaagatggagaaaccccgtctctactaaaaatacaaaattagccaggcgtggtggtgcatgcctgtaatcccagctactcagaaggctgaggcaggagaattgcttgaacctgggaggaagaggttgcagtgagccgagactgcaccattacactccagcctgggcaacaagagcaaaacactgtctcaaaaaaaaaaaaaaaaaaaaaatccacctcctttttctgcactgctgggtaggattccactgaatggatataccacattttatttagctacgacctcatcaagggaactttaggtgttttccagtttctcaccaggatgatggacatttttacacaaggctctttgcaggtgttactctgggtcagaaagtaaaaatccctcgagacggggattgcaccaggtcccggtcctcagccccactgcacttcacctgtgtcaaggccacgggaacccttccaccgtctctgccagcagatgccattcagcacccaccccaagatactcatactttgacccggaagagaccagaagcaccctgcagttcgtgtggacaagtctcccctctgacttacagtcccctcaccctcgtacctaggagagggatggcagcgctgagggtcgtgggattctcttccctggaggctcccccatcctcgtggcctctgcgcggtccagctcccctccgagctggctcaaggggtaacttgatccaggtcagctggtggagtatgaggtagcgtctagctgagcgtcacggtattttattaagtccgaaatgtgatcgctactgttgtcacactttagcgcccccaacaatccccttacaaatgagaaaaacagagcctccccaaatgcctttcctctgacatcaaggaaagcgcatggaaccctgcccagaggcctgagcccgggtgaccccaggagtggctccagagcttgaggaaaggcctggggggcggagggggtgtttttccagtttcaggcaaagcagtgagctgggggctatctgctgtttcctctgcgcctgggtctgtaaagtcagcggttgccgtttaaatcccattttccttaacatgtcaggattgctcattctaggccatccatttatatggccatggctcagaggtctcagactcacatgcctagtggggtcaaggatccaggtaacgtaaactgaagcaagccccgtagagatggtgggaaactgtaaatggatgccctggctgaaggaggtagctgaaaatctggagagagaacaagaacaagaagagaaagggaagaggaggcagagagaaaagagagaggacatcccccaagtttacatattgcccattgcttcaaaaaaatttaaacatgcaatgagctaagtaggtatgtctccaggccagtttgcaggctcttccctaactgaacttatcaacacagtagacaagctgccggcctggctccctcacccctctagagcagcactgtccagtagagatttctgcgatgataaaatatctgcagcgttcactgcaataaccactggctacatgtagctcttgagcacttgaagtaggactaaagaactgaacctttaatgttatttaactttactgaatttcaatataactataactagccacaggcaactaattgctaccatattagacaacatggctctagattctttcaatgtggagggtatcatcgtgcttgactactgcaaaaaagatcactccttcttggggagagggggtagattatacctgagaccaccaagcattaatcagagtcctgggtaaatggaaagaaaggaaattcgaaatactgagcagtaaaagcttaggtgtaaccagatgtctgctggctcaagagtggtcactcagtgtccttccactcccccacttcccagtgagtttctcattcagggtcaccctttagcatccactgtgttcttggccatctgcttactcccatttgcccagagctgacccctaggaagccacctgggggaacttccctgctgccgttggtctccaggccttaagagcacaccactgtccaaacccagggtgctgcccgtgggtcacagaggtgcaaggtcctatgcagaggcgagaacggcagttgcactttgtcacctgccacaaagttgctgtgcctgggcccatgtgtgtcaaggactctggaaacaagcctcacctttcatcaaaaccctttctaatctgaggcccattcaaggggccggagagggaccagcagccgcactacccccttgccaacccctctctcagattccagcccagctccccacagggcaacccaggctgccccagatgccactgacccctctcttgcctccctaaacatcaccataacaacaagactaccttatgtatcttttaaaaattaatgaggaggcctgtaattctaccactttgggaggccacagcgggaggatcacttgagcccagaagttcaagaccagcctgggcaacatattgagaccctatctctatttttcaaaaaaagaaaaaaaatgaatgaggtaggggcttcccaccatccccctgcaaagcttatattctcaaagataaattcaagccttttggccaggcacggtggctcatgcctgcaatcttagcacttcgggaggccaagactagaggatctcttgaggccaggagtttgagaccagcctggccaacatagcaaaacctcatctctactcaaaatacaaaaattagctaggcatggtggcacacacctgtagtcccaactacttgagaggctgaggcttgagaatcacctaaacctgggaggtggtggcagtgaactgagattgtgccactgcactccagcttgggtgacagagcaagactgtcttaaaaaaaaaaaaaaaaaaaaaaaaaaaaaaaaaaaaaaaaaagctttttgcttgtccaattgtctaaaaagagatctgttcaaaatgttgcaaataccctttcttccaatttctctactcccatcaaggttccagagatgttacaaccaattttttctcagtagtcaagctcagagtcccacgtgcttctcctcctccagcagcctttgtaaggaggcagctgcctcgagaaatcaccttgcaactaaactgtgggaaaatgtgtaagatcttaacacagtggtagaaactaacatgtatgcagtagccactgtgcacccgacactgttctcggtgctctcatgcagcatctcgcttctcctcacctcatctggaggtgggttcagttatcaggtccatttatcagtcaggcctctggggttcatgagggtcatgcccctcactcaaggtcacacactgggaagcggttggatccaggatccaggcccaggcagtcagattccagagcctgcaccctgaaccagtaccgcaggggctggcacccccgcacattttttgccccatcaacatattatcatgtcactccgccagcatcatgaagtgcactcatgatatgtttgccccatcagcgtgtcacgagggcatttcatgatgcaggcggggttggcaggtgtgcatcgtgtaggctccacatgggacatggcatcccttatgactcttggctgcaaagtgccagaaacccagctccactcacttaatctgaaaagtgggtgtatttgttcgccagggctgctgtaacaaatttcccccagttactggcttcaaacaacacacacgtgtcctcttacagttctggaggtcaggctctgagaggagaatcggtttttttactttttttttttttttttttttttgagacagagtctcgctctgtcgcccaggctggagtgcagtggtgtgatctcagctcactgcagcctcctgcctcccaggttcaagctattctcgtgcctcagcctcccaagtagctgggaccacagatgtgcaccaccatgcccagctaattttttgtatttttagtagaggtggggtttctccatgttggccaggctggtctcgaactcctggcctcaagtgatccacccgcctcagcctcccaaaatgctgagattacaggtgtaagccaccacacctggccctttggttttttgtttgttttagtttttcttccagtggccacttgtgtatgttgactgtggtctcttcttccatcttcaaagcacatgactccagtcaccctctcctttctgtcatcagatcactgtctctcttacagggacccatgtgattccatttagggcccaccccgacagccaaggaaaaacttcccacctcaagatctctaactgaactaaagtcctgattgccatttaaagtaatagatttgcaggttccgagataagaatgtgcgcatctttgggggttcgttattcggcccagcacagtcagggatggctcagcttcagtcctgactggatccaggggatcagatcgcatgctcatggcatccccctctccagctcgcagccctgctttcctcagcagctcccggcttaatccaccattcaacagccccagggaagagacagcacctcttccaaaagtgccagccaacgtccccgggctggttcccattggcccaccttagaccacatgttcatccttgaagcaatcactgtggccagggggaccttgggtccctctgattggttttcattgtccccaccccgtagtcttttgtttttttgtttttttgttttttttttgagacagagtcttgctctgtcatgcaggctggagcacagtggcgcgatctcggctcactacaacctccacttgctgggttcaagcagttctcctgcttcagcctcccaagtagctgggattacaggcagctgccaccacgcccagctaatttgtgtattttagtagagacagggtttcatcatgttggccaggctggtctcaaactcctgacctcaaacaatccacccgcctgtctcccacagtgctaggattacaggcatgagccaccatgcccagcctccaccccatggtcttgtcccacagagagaggtgtttccccaaggaaactgagtgggaaacagcatggcattggagtttgttcaatggcaagccctggggatagtgcctggcacatagtaagcgctcagtaaatgatgatcacagatcatgaggcacagcaggtgtccctccaggagccaatacttgaagagcacagggtttactaagcagatgtaggcaggagagcatttcaagcagggggaacacctttagcgaggcagaggtgtccaccatatggccagggtgaccaaatgtctggccatacttgggaagctggggacctaggggagtcctggtttgaacctatccccctagtataataccatccccctttaatgcaaaactctctctgtttggagagtatctgtatggtcactttccttgcagtcaacctgctcatttataaggaaaccaaacagacaaagaggatgagattgaacccaaggacctctaaccttgagtgtccaaatccagactagaacccgagcctgatgactcccagtgcagtgctcatcccagccctcagcttatgaggccaacccttgaaggctacatcagattaaccaggcatgttctctctctctctctctctctgtcaaattttccataggattgtgaccagatccacgttgatgacgtctcatcagatgacaatggccaagatttaaggtgggaatttggggagtcaaaaatgcccattgattgactgattgattatcaagttatccttctactaggaagtggggtgggagaggagggctgcttataaggacaaggtgtgcctgcctccagccagaactgggacttttgcatctcagactcaaaaatcacaactagccgggtgtggtggctcatacttgtaatcccagcactttgggaggtcttagcaggaggatcacttgagctcaggagttcaaaaccagcctgagcaacatagtgagacccccatctctactataataaataaatgagtaaaaatttgtttaaaaaatcacaacctcacccctcaaccctacagtctcttgctcatcacctcaaatcactaaactctgctcatttattgctatttttttcctgcttactgaagtaatgcatgcataacagaaaaaattcaaacacttaacctgacctcacctcccaaactcaccaccattaagagtttagtatatattcttcaaagatctgctcaaaatgttgaaaataccctttctttcagcttctctcctccaatcaagggtccggagatgttataaccaattttttctcagtagtcaagctcagagtttcacgtgcttctcctcctccagcagtcttcgtaaggaggcagctgcctccaaatatttggttgtattcattagcatacatatatatatttttttctttttcttttttttgaggctgactttcactcttgtcacccaggctggagtgcaatggtgtgatctcagctcactgcaacctccacctcccaggctcaagcaattctcctgcctcagcctcctgagtagctgggattacagtcatgcaccaccacacccagctaatttttttgtttttttagtagaggcggggtttcaccatattggccaggctggtctcaaactcctaacctcaagtgatctacccacctcagcctcccagagtgctggggttacaggcgtgagccaccgcacccgaccagcatgcatatatttttaatataacaattgatacagccaatacttaagaaacacttctcaaatgaataagtggtgtgtctggtttctaggggaaaacactcccaggacatggcttccaggaatcaggtaacccattgcttaatatgagacaccttcaggccgggtgtggtggctcacgcctgtaatcccagcactttgggaggccaaggcgcaaggatcacctgaggtcaggagttcgagaccagcctggccaacacagtgaaaccccatctctactaaaaatacaaaaattagccgggcgtggtggcgggcgcctgtaatcccagctacttgggaggctgaggcaggagaattgcttgaacccaggaggcggaggttgcagcgagccgagatcgtgccactgcactccagcctggggtacagagcgagactccgtctcaaaaaaaaaaaaaaaagagagacagcttccagaggaatgtgggctggaatgttccaagcctgcccctgggaaaactttgtaaaaatggaaccatagttaatctgtgctcatccaaaattaccacaattcaacggctttaggctcatcagatatattattagaccaactaatgttttggttacgggatcagtcattgtaactttatttagtagctgcttccaaggtgtctctcccaacttactgcaaaaacaaaaatcaaaatttctgttcctgagccctgcaagtcttttcaaagcccggcacaatcggaagtgatcagccggcagatgcctgcttcattttaatcagccattcggaaaatcccttctgcaatcaggactggcaaggagcaaagctccagccccaccaggacttctcacctgatggagtaaataaaccccagatcaaggttaattggtcctttccatgaagtcatcgttgggaagcactcttcctttcaaggcagtgagcagcaccgttctgtttctatagtttcccctgtagctagctggcttggaattgagagcaacagtcctctgaaccctgtctcatgctgagctgtttggtacctcactttgagaattctcagcccaagggtgttttcttccttagagaccaaattctccacttattcattcaagaaatatttatggagtacctactatatgctaggtcccaaacatgaaatgcctcttgtttgtttttttgttttgttttgttttgttttgtttttttcagttagcagtaagaaccaaccttcagagatgcctcgttttgtgccatgttctattctaaatgcattacatgggataactcattgcatatccacagtaaccctaggagagagagatgcttttatcctcatcctcatttttcagctggggaatgtgaggcatagagagattgagcaattggcccaaactcacatggctggtcagcagggaaggcaggattcaaatccaggcagcctggctctgggacccaagctcttaacagatcctctgtccatcctggacactggttcctgccctccccaagggcctccatctcctaacatctagacatctccccatggtagcatctgagttaatggtgagcgttcactttttcaagaataaatctatggccgggcacagtggctcacgcctgtaatcccagcactttgggagcccaaggcgggtggatcacttgaggtccggagtgcaagaccagcctggccaacatggtgaaaccctgtctctactaaaaatacaaaaaattacctgggtgtggtggagggcacctgtaatcccagctacttgggagggggaggctgaggcaggagaatcacttgaacctgggaggcagaggttgcagtgagccgagatcatgcctttgcactccagcctgggcaacagagcaagactccatctcaaaataaattaaaaaaaataaaaaaaataaaaaaataaaaagtcaaaataagggacgaggcacggtggtgcatgcctataatcccagcactttgggaagccaaggtaggaggatcccttgagcccaggagttcaagaacagcccaggcaacatagagagactccatctctccaaaaaataaaaataagttagccaagtgtggtggcgcacacacgaggagcctgtgggcccagctcctcggaaggctgaggtaaaaggatcccttgagctgggaggttgaggctgccatgagctgtgatgacaccactgcactccaacctgggcaacagcgcaagaccctgtctcaaaaaaataaaaattaaaaaataaatgaaaggcaaatggatgtggatcaggtaagagcaaaagacaccacttttcttggggaagctaatgaaagctgtggtcctgctgccccccaaatgcacactcgcagcaccctgtgcatttcgaggggctcatggacacccaaaagcccacccgtgggtcccacagagcctgtggtctcccagggaagatgccctgcacccccctgcactaacactgtccctcccctcctctctccgcagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtggtgagtactgtgagccttgggcctccgaggaagggaaactcattgggatggatgctgtcagtgtccctgctgtgccaggcgccaggcagagaggttcacaagttcagtaccagcccacttaatgcaaccctgacgacacccttcggaatagagcactgggattttgtcaccttcactttgggggtgggaaagctgagggacggaggctgcatctggtccaagatccttcaggccacaaatggcgcggggtggacgtgggggcggaattctcttacccacagccagaggctctcacagtgtggtcctccaagtagcagcgacagcatcacctggggatgtgttgaaaatgcagattctctggccctacctcaggcctagcaaatctgaaactctgcgctggggcccagaatctgtgttttcacagccctggaatccccccttggattctggaattccagaatccccctggaatcgggaggacctgtgccttgagtctttgcatctcagattgttgtccgcagaccaaccacatcagcatcccccggagctggttagaagtgcagggtcaccagcaggcagagtctgcagtgacccaagattacaccactgcaccccagcctgggcaacaaagtgagaccccgtaaaaaaaaaaaaaaaaaaaaaaacgtgcagggtctcaggcctcatcctgggcaactgactcagaatctgctttaaaaaatttttttttatttttgagacaaggtcttgctatgctgcccaggctggtctcaaactacttctggcctcaagtgatcttcccacctcagcctcccaagtagctgggattagaggcatgcaccacctgcctggcccagaatctgcatttttgacaagcccgccaggtgactgtggaggcattaaagttgaagaagccctagaagtcactggttctcacacgtggctctcattggaaccacccagggagtttcagttgctggtggtcttggtatcactgcagcctggacatcaggagtcataaagatccctggggaattctaagtgcagccaaggagagacccgccccctggcttcaggtactaggaacatttgctcattgccccaaacaagaagtctgaaggcactgaaggcgaggctggctcagccgtagtctagagaattctggagttctctagaacagaggtttttaactaggggtggtactgcgccctcctcaggagacatctgggagtcttcctggttgccacagtgcctggaaccaaccactggcccataagggcagggtttgagtaggtggctaatagtgtctgcaatatacacattggccccaaaaacttctagggccccctccctccattcctagaaagaatagagtcccggttctcaaactggacagaacacacttccagtcgcagctctacaactttctagctatgtggccttaggcaacatacatacggtcatcttaatgagccttagtctttaaatctatgaaatggagaatacaaatacttctgcttccctggattattgagagatttattgttagtgcatacaaaaggcatgactccatgcctgatacacagcgggaactcaataaatggtggcatttgtcacgagttgctctcagttttgcttgggagcctcgggttcccctgcgtcttctactgtccctggagctttcccatccgttctttgggacagacttcccgtcgtgttcatggctgcggtgctaatgcagcccacgtgctaagcgcggtcctggcagtagctaatgtttaaggagcactcgctctgccagttttgccaccgttttcatggactagctccttcactcttcacagcatgcctgtaaggtaaatgtttttatcaacggtgttgcttgaaagcagaaactgagatgacggaggttaagtaacctgcccagcgtcacacagcccaggcagaagggccacagtggagtcccaggctgggtgactgcaccacctctgcccttcagggccacacttggtggcctctcagatgtgagtgtgttgattgcaggagtgaagcagcaagctctggtcaggtcccagcctttgtacccagccctgcacggagggaggaggggagcaggagggctgactcaggtgagacagggatggggttggccgccagagagcatctgttccccatccaggttaaggcccaggaaatgccagggctttgtcaggctgctctgctcacccatagctgaggggagagcacccaaggcgtcagccagtgaggagcccacagccagcggcatgccggtctccttccccaacccagctgttcctgcatcacagaactagccaggtgcatggccgtggcttccagcccagggatcaccacagatccccacgattccaagtgttttagaaggtacactcggaagaaaggcatctgcaaaatacagaatagagaaaatgcttagtaaatcaccatctaggaggcaggggttgaaatcaggggccttagcctgatgtcatccttccatctaccacttcccatgtagctctgagcaggttatttgacctccctgtgcctcagtttcctcctcgtgtgcaaaatggggccagtgatgctgcccagcatcattggtagatggctaatagtgtctgcaatatacacaatatacacaaggattcatgccaggatgttgtgaattcacacaggaaaggtgctcagaacggcatctgacacacataagctctcattaagtggcacttttgttatctggggaaggtgggaaggaggccaagcctggaggaaaacgccgaggaaacagcttgaagcacacttcccagcgtggagcaaagtaggggtggttgggcagccagctacacaagacagcacgttgggaagccctttgtcaactgaaaagtgctgagccttgtgagtttgtattgttactgagggttccagctaagggtctgtggggaaggtgcagagacagaggaaaaccagaggccgtgtgttctcctagagttgatagactaatgagaagatgggacatgtagcagtaagaagattcattcattcattcattcttccacgtgtccatcgtcaaaggcctaggttgtggattcagcagtgaacaaaagaaacaaggtccctgttttcaaagagtttatattcagtgagtggaggaaacagaccatcaacaagtgagcaaatcacttaaattctttttttttttttttttttttgagatggagtcttgctctgtcacccaggctggaatacagtggcatgatctcggctcactgcaacctctacctcccaggttcaagtgactctcctgcctcagcctcccgagtagctgggattacaggcacatgccaccatgcccggctaatttttgtatttttaatagagatgaggtttcaccatgttggccaggctggtcttgaactcctgagctcaggtgatccacccgtctcagcctcccaaagtactgggattacaggtatgagccaccatgcccggctttaaattcttaattcagtcatttcgaggatgatcacacctattgaagaaacagatatggcagagagcccagcgtgggcagtggtggccaggggatacttggaatagtagacccagagtccatctctcaggaagggctatttgaactcagtattctaaatattctagatgagattctaataatgataaccagatgcccagagctggggaatgaccaatacaagcaaagagtcaatcagttcagctacattcaactgcataagtaaaagaacaaccaaccaaaaaataacacaaaaaacaacaatggcttaaaccagatagaaatgtattttttttcttatatacaaaagctgtaggcattccaagctggccaagtactctacagtgttatgagcccaggatcccaggatccttctttctttttttttttttgagacagagtctcactctgccacctaggctggagtatagtggcacaatctcggctcactgcaacctccgcctcccgagttcaagcaattctcctgcctcagcctcccaagtagctgggaatacaggcgcctgccaccacacccggctaatttttgtatttttagtagagatagagacgggatttcaccacgttggccaggctgatctcgaactcctgacctcagatgatctgcccgcctcggcctccaaaagtgctgggattacaggcatgagccaccctgcctggccccttctatctttgtatttatttatttatttattgagactgggtctcactctgtttctcaggctggagtgcagtggcatgatctcggctcactgcaccctcgacctcctaggctcaagtgatcctcccacctcagccttcagaatagctgggaccacaggcacatgccaccatgcctggctaatttttaaattttttgtaaagatggggccttcctgtcttgcccaggctggtctcaaacccctggctcaagcgatcctcccacctcagcctcccaaagtgctggggttacaggcgtgggccacctcacccagccaaaatcaggattcttattactaatgagaagatccttttgtatttatatttttactaattacaagtgaaaaaaatggatagtggatggcaactaagtgtctaccacaaacagcaaatgaaaagtctctgagacaaaaagagtttgacacttttcagaaagataaagaaggccagcatagctgaatagctggagtgagggggcacgtggtccaggacaggatgagagagctggcggtgtccagatgacataaggcccagtttggacactgggctcttctatgtagagaagacgatgtctccatagcacaggcagcattttgtcctaattaattcattcttccttcaacaaatactgattgagcatcaagcacaggccagcccctgctacagaaactgctgctatgatggcgaacaagactgacttggtccctgccctctgccctagagtgaatagcctaatggccaaggcagatgccaaacacatcgtcacacagatacacttaaaattagagttgtgagaagtgctgtgaagaagagctacagtgtgttgggagaatataaactaaagggacctgacccagcctggagagatcaggttagaccttccagaacaaatgacatttaagatgaggccgtaaggcaggatgcagaggttcacacctgtaattccagcactttgggaggccaaggcaggattgcttgaggccaggagttcaagaccagtttgggcaacatagcaagaccccacctctatgaaaaatacaaaatttagccggacatggtggcaggcatctgtagttccagctactcaggaggctaaggtggaaggattgcaggattgcttgaacctgggagactgaggctgcagtgagccttgatcacaccactgcactccagcctgggtgacagagcaagatcttgtctcaaaaaaaaaaaaaaaagacaaggcccaaatgcagagtgtgaaggatttagccaggcaaaagcagaagatgagataaaagagtggtccatgttctgaaatgaggtgtgcaaaggtcctggggcaggagtccacttggtgtttcagggaacaaacgaggcctccaggctggaatggaaagacagcggcaggagatgaaactcagtagggacaggatcatgctgctgggggttttgaactttatcttaaagctactgaaggctgagagaatggcaggttgagaaatacccagggtagctctggaagccagctgcctgggtgccggacctgtgtccatttttgttcatatctgtgcattcagtgcctattacaatatcaagcacctagaaggcactcctgaattttttgttggatgcatggatggatgaatgtgggggtagataggtggatgggtggatgggtgggtgggtagatgggtggatgggtgggtgggtggatggatggatattgggtggatggatgggtagatacgtgggtaggtggatggatgggtggataggtgtctattattttctccctatggtgagcaagtcagtcaacatcacaaagcctgtttctttacctaaaaatatagaaataaaaatggtgtccacctctatggtcattgtgagaatgaaataaatcatgttaaaagcagagccctgcacataagcactcaaaaatgttcatcattttttatgttattattaattccctgtctccaccataacaatataagctctataatctgcatatttttgttcatatctgtacattcagtgcctattacaatatcaagtacttagaaggtactcctgaattttttgttggatgcatggatggatggatatggggtagatgggtggttgggtggataggtgggtgggtagatgggtggatgggtgtgtgggtggatgggtggatgggtgggtgggtagactgatgggtgggtgggtgtgtgggtagattgatgggtgggtgggtggatagatggatggttggatattgggtggatggatggatgggtggatggatggatattgggtggatggatgggtggataggtgggtgggtggatggatggatggatattgggcagatggatggatgggtggatggatggatattgggtggatggatgggtggataggtgggtaggtagatagatgggtggataggtgggtggatggatggatggatgaatggaagggtggatgggtggatgggtgaatcagtcagtggatggattaatctatcaatctgttgatctcaggataagattgagagaagccactggattgaagtttactttgggttgtcatctgattttaaccctcagggtacagtagctagattcctgttccctaccttcatcccccagatctttctaatacgatgactacatctttatttcctttgtccacagggttgataggcactcccaaaagggagacctggctacagctccgagctgagctggaagctctcacagacctctggctgacccactccctgaaggcactaaacctcatcaactcccggcaagtggcagccctcattttcctctgtgccactgaactttctcgcagtagacagtggtggctcctgcatgtccacacttgggagaattggactcctcaaactctcacttgtacactttccaaatattttttttttttgatatggagtctcactctgtcgcccaggctggagtgcagtagcgtgatctcggctcatcacaacctctccctcccaggttcaagcaattctccggcctcagcctcctgagtagctgggattgcaggtgtgcaccaccacacctagctaatttttgtatttagtagagatggggtttcaccatgttggccaggcttgtctcgaactcctgacctcaggtgatccacccgcctcggcctcccaaagtactgggattgcaggtgtgagccaccactcccagcccaaatatttaataaagcttaagtgcacaaggctcagtggataccttggagcatagctgagctaatagcggcagagacttttcagggcccaacaggtttccaggtttctggattctcccaaaagatgagaactggcatgcaggctccagcttactctattccccacctctccctcttgtcctacacttgttccatatcactcatttacattacccgcaactatttaagtgtatggcccttgcaataaacatttgctttttatataagaaaagtattccccccatactacatttcactatgtcaggcagcttcaggcttaaaagagaggaacagcctgagaatccttgggccctaacatacctgaagatgacagccatagcctccaagcctaccagatttcccgccaactgcaggctcatgcagcaagaggaggcctggccttgtggtccctctgagttctgatccacagtctcctttgtccttaggcccaactgtgtcaatgtgctggtcaccaccactcaactaattcctgccctggccaaagtcctgctatatggcctggggtctgtgtttcctattgagaacatctacagtgcaaccaagacaggtagggagaagccacacctcggcggggatacagggttggagggtggggttagctttccatcctgggaatggggtgtttaaggaacatgacaccacagaaatggatggagtgtgcctatggccatgactcagattcccaaaacagcccccatagaccacatgccttaacctctgcttctaaagaaattggttaggaccacagttttccaaagtgtctgtatgagttcagatacaggcaaagctgctgtaacaaacacaccccaaatgcaagggcttgcaaaagagtcaaagctgatttctccctagtagaacagacagaggtgagtgatccaggctggtggggtgaccctgtcctcagagacatccagaaacccaggtctctcccgttttatttttccaccatttcttatggttttattctcatgtatggggtcaaatcagagtcctagcccatcctcattctagcaggtctggtatttgaaggccaagctcagaaggctatgtacattacattctactcacttcctgttagccccagcttagtcacgtggccacaagtagctgccagggaagctgggaaatgtagtccatagctgagtgattcatactgtcactcaatctggaatgcagtggcgagatcatagctcactacagcctcaaactcccagcctcaagcaatccttccacctcagcccccaaagtactgggactacaggcatgagccaccgtgccaaaatatttttaattagaaaccttttccattgttttttctctagagcaaaaaataaaaaaaataaataatttatagtactttggcagcattttcttggagcaattttggttttactgaagttctacgtccaaacattatatgaaagtgccttttgattttaaaattatagtagtaggggccaaaatggttgttgaagatttttcaacaagatcctgtcttttcatttttcccatttttcctgcatacctcaagtacctttgcaggtttatttcgaatctcttttttaaataatatttttatttttaattgtggtaaaattaaataatgtaaaattttcaccatcttaaccttttttcttttttttaagatggagtttctctcttgttgcccaggctggagggcagtggtgcaatctcggctcactacaacctccgcctcctgggttcaagcagttctcctgcctcagcctcctgagtagcaaagactacaggcgtgcaccactacaccgagctaattttgtatttttagtagagacggggtttcaccttgttggccaggctagtcttgaactcctgacctcaggtgatccatctgcctcggcctcccaaaatgctgggattacaggcatgaaccaccgcacctggccatgcactatacgcttaaaaatggttaagatgggtcaggcgcggtggctcacgcctgtaatcccagcactttgggaggacgaggcaggtggactgcctgaagtcaggcagttcaagaccagcctgaccgacatagtgaaaactcatctgtactaaaaataaaaaaattagcagggcatggtggcgggtacctgtaatcccaggtacttggaaggctgaggtaggagagtcgcttgaacccaggaggcagaggttgcagtgagccgagaccaggccattgcactccagcctgggcaacaagaacgagactccgtctaaaaaaaaaaaaaaaaggttaagatggctgggtgcagtggctcacgcctgtaatcccagtactttgagacactgaggtgagcagatcacttgaggccaggagttcgagaccagcctggccaacatggtgaagccccatctctactaaaaaatacaaaaattagccaggtgtggtgatgcgtgcctacagtcccagttactcaggaggccgaggcaggagaatggcttgaacccagaaagtggaggtttcagtgagccgagatggcaccactgcactccagcctgggtgacagagcaagactgtgtctcgaaacaaaagtgtccagcgcagtggcatcaagtgcattcaaatggttgtgcatccattgccacttctacatcggacagctgcagagacttgggagcctgctctaacccctgcgctgcctcctcctgctgtgttgccctgggcaagctactgaccctcgctgtgtttccggctgtcatcatccttcatgtggggatgataacagggctcacctcagaagtttgctcaagaacgaaatgatgaataccgggcctttgggagcacagctgcaggcaccaagctcttaatgagcgggtattggctgcaatccggggtcctcacagagcgttttttctttccttcctgtgtgcgtgcagggaaggagagctgcttcgagaggataatgcagagattcggcagaaaagctgtctacgtggtgatcggtgatggtgtggaagaggagcaaggagcgaaaaaggtacttcttccacctctcagactgcgttttcctgctctttcgagcacccctcgtggtcttcaagggctccttccatgatttcctccactccccgtggctggctgggtcctccttcccaggctccttgcttgccagtccattccatttgcaaattgcagaagcatcctgagtaatttccttctacaaatccccctctctgcctctggctgctgcccctggtagccctggattgtttctgggacaactgttcgggagcctagagacgctccggcagggcaggctggtggggggccagtgcacgtgcatgtgttttatttaatacttactgatcatatgttccagcaacccttcccagttaataaagacagcattaagctaatgaaaaagaaaatcctgcatttgtgatctcgggcccgtgaggagagggcagggggttctggtggccacatctctgttcttggaaaagaaacagctgccaaagtcctgggtctggatctgtcaacagcgccccagagaggctgccacccccaacccggaggcctgggaagtggattgttaatgtcacagaccttaattagggggacctggtttcccccatctctgcctggcagcaaatcccaaggaaatgcaaaaatgttcagggtctcagcagatgaaacccagaagaagagggaagccctagggtcctgggagagggccccgggagagaggagcttggaaggctttgcaggcactgttccctccacctggaaggctcctcccctttcctgggagatgtagtctctattatccgccgccatgagccccgctaagaaatgggagctgcttctgagagagaaggggagaagtgatattgaggggcagctgccagggtcagtcgcactggtgtgtggccaggctgtggctggcatcttgagttgctgacctaaccccatgcccttcaccaccgtaactttattgctaacatcatcattgtactcaatcctccaaaaactcctacaaagtgggtatcattgcatccctttttttttttttttttttttagagatagggtctcactctggcacctaggctggagtgcagtggcacaatctcagcttactgcagcctctacctactggactcaagcgatcttcccacttccacctctaagtagctggagctatggacaggcaccaccatacctggttaattttttgtatttttttttttatagagatggggttttgccatgttgcctgggctggcctcaaactcgtaaactcaaacaatctgcccaccttggcctcccagaaagctgggattagaggcatgtgcccggccacaccccattttatagatgacagaatttgagactcagaaaggttaattaatttgcctagggtcacacatctagcacatgcaaacctacctgtgtcatgctccaaacgcctggcagggaggagacggacttacgagtttcaaacacggttggttttcacccctgagctagtcaggcaagagtagagtcagccaaagaagactaggtacacacccaccacacacagaactcccataaaagtcccagtgtctgaggcagaagcctcagaacgttagtgagaaacagtgtccaccagcagctctctcagcctgacaaatggaagtcattagcccaggccaccggaaatctgagcggtgtaaaatatggccgcaggaccaggggccttgactgtttccgctgacagtgttgttaatatctccattttagtgggtgatttgtctccacctcttcacgagtgatgaatccactggcactctggaacctttaagcctggggtaaaggcggctagaacattctctttcttccacctttgctcattctctcccagaaaaatgaatcacactcttttttttttttttttttttttttttttttttttttttttttgagacagaatctcactgtgtcgcccaggctggagtgcagtagcatgatctcggctcactgcaacctccacctcccaggttcaagcgattcttgtgcctcagcctcctgagtagctgggattacaggcatgagccaccacatgtggctaattttttgtaattttaatagagacggggttttgccatgttggccaggctggtctcgaactcctgacctcaggtgatccgaccacctcagcctcccaaagtactgggattagaggtgtgagccaccacactcagccaaattacactctttaaagagggcaggattggccaggtggcaaccagaatctatctttgcaaagaaaggagggcttggccgggatgagggcagggtgggaatgctagggcagtgagaaggcgttgaagagatgagagctgttcccataggagatggttttctgcttcccttgagctgagaattgtttagaaactacagaacaaagagaaaaggatacattcagaggactttgcttgagaaacttaccttctttttttccctctctctcttcctcttttcattccttctacgaatatttcttgagcacctactatgtgtcaagagccatgcggtgcagcaatgagcattgcattccaagctcaaccttcctggggcctttgcacttgctgtgtcttctacctgcccccacgttcccccacatctttgccagggcctgcttaaatgacactccctggagaggcctttcctgacccagctctcaaaagtagacacacaaagctgctttctaccctatctcattctgtttccttcctagcacttaccaggagatgaacttatcttgtttatttcttatctgtgggtttatctgagcctccaatgaaagccccataagtgtttgtgacctgtacagaaggccccactggggtctgcccctggcatctttatagatcttcctttgctcactgagggattctcaatctgggatgcccttcccttcagtgacctgctaactatgaagcacttattcttttttttttttttttttttttttttttgagatgaagtttcactcttgttgcccaggttggagtgcagtggcatgatctcaactcactgcatcctctgcctcctgtgttcaagtgattctcctgccccagcctcccaagtagctgggattacaggtggccaccaccacgcccagctgattcttgtattttagtagagatggggtttcaccatgttggccaggctggtctcaaattcctgatttcaggtagtccacccgccttggcctcccaaagtcctaggattacaggcgtgagccaccacgcccggcctcctcattcgttcttcaaggtctgggtctcatgcgcttcttgtcccctgagacacccccatcccattcacttctaccaaaaaagaggctgcttcctctggctggctcccatgacattttatttacacctgccttaatgatttctttacattcttcctaaggtagtcttatttattatcttttaaactactgagaaacgccagcattctttcttccatatacatgcacatatatatacaatttgtcctgcatccttcctttttcctatttacctagatatgtccctagctactcaggaggctgagtcaggaaaatcagttgagcccaagagatcaaggctgcagtgagccatgatctgcattccagcatggacaacaaactgagactccatctctaaaattaaaaaaaaaaattaatgaaacgaaattcagctgggcacaatggctcatgcctgtaatcccaacactttgggaggctgaggtgggtggatcgcttgagcccagtagtttgagaccagcctggtcaccatggtgaaaccctatctctacaaaaaatacaaaaattagccagatgtggtggcatgcatctgttgtcccagctacccgggaggctaaggtaggaggatcgcttgagcctgggaggttgaggctgcagtgagcagagatcatgtcactgcactctagcctgtctcaaaagaaagaaagaaagaaaaaaaaaactccacatcatgacaataacttgaagcaggtaccacctgctgcaaagaaaaggaaaagataaaaacgaaagctataaagaaaacagattagtgtcatctgacctggctagctacagtggcctgctgaagactctccaagaccagctctgtttgttcacagtggagactgtcaatgctggggaggggttccagcaccgagctgtgactttcttcttgaagtaacaggattcagagcactgcagcctccaattcccggcctcaagcaatcctcccgcctcagcctcccaaagtgctgggattacaaacgtgggccacagtgcccaggcaagaacaaatttttaaaaaggaatcgctttcccattgtgcaatttaacaccatgtcagtgcaccgcctaagaccacgctggtaccaacagaggcgagagggtcaaacagcgaacacgctgggcagtgctggataagcccgtcagagcaggctctgaatagaaatggttggccatactggtgggtactggccagatgtgggtctgccagcaacatcaagtgccccatagtttgggaagtccccacgtgctagacttaactgggttgacttctcacatgccctctaaccacaggcgtggaacccgggggcaggggcggggccataaccttgtggctggtgttctgtgtttcagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaagtggggtaggatgtggttactttattaccactcttgaggcttccaaatgtgttgtcctttttaaagactttatcagttgcagaagaatagaatccaactcacactggcttaagccaagaaaaatggggtggggggagggaggaaggagaagagggagaaaaggagggaggcagaaagggaggggaagaaggacaaagggacaagtgtctccaggaactttaggtggtatctgtctggatccgggtggtcaaatgaatttctctcatgtggccgtaattctcaggcaggctgttccctgtgtggcaaagacggctctacgagtccttcagcaaaaccacacagacagaaagagaccacattcttcaccgtggtgcagcgaaagcctcaggactgtaactcgttggccaaatctgaggcttaggcaactcacggagctggatttagggttggatcctgtcacgaacagcaagttgaacaagctgatcctccaagggaaagaaaatcagtgagctgttattcaaagaattgggggaattgagggtcgggctggaaaatgcaactgacttccgttctaatggtaggacttcatttcccagtggatgggacatgagtgaaggatccagtttaaggggcaaggagggaaatctggagaagttctgaagacatctggagcactgccactacccatagtggaccaggcaggacctgggtctatctgattggatgctaagcaggaatataggctccttccttattaatgctggtaaaatcgtggattatcagtcagctgacccatgtcatgggagatggagatctctgccactggagtctcagagctagaatctctgatgattagaaaactgtcaccggccaggcatggtggtgtatgcctgtaatcccaacactttaggaggccaaggcatgtgggtcgcttgagcccaggagtttgagaccaacctgggcaacatggtgaaaccccgtctttacaaaaaatacaaaaattagctaggcatatagcatgcgcctgtagtcacaactactcaggaggcagaggtgggaagagctcttgagcccaggaggttgaggctgcagtgagccaggttcacactgctgcactccagcctgggtgacagagcaagaccctgtctcaaaaaaaaaaaaaaaaaaaaggcatcactaagggtcagatagactcccttactagaccctgagcttctcagggggtaggtactgttggtttcatctctatatccacagaatcaagcacagagcctgacacaaaatagaatcccattatagatggcatagaatgaaggatggaaatatgaatggaaccacagccagatggatgataatatgggtgaatggccatttggacaaatggataaaatggagtgttaaacagttgagtacgtgggtagatgaatggttggttaggtgattagatgattaattggaaggtgggtgggtaattgggtgactggaagatggatagatgaataaatggatacctacttgggatgactagatggatagttggataaatcatgggtatatggacgaacagatagattattggatagatgaccagatcgataaccaagtagttgtgtggtgacatgaatgaatagatggtggtttggatgagtgaatggctgggtggttttacggaaatatggatagatggttaggtgggtgagttagtggataaatgagtgggttgtttggacaggtagatggatggaatgattgatggttgttggtggttgataataatattatgatggatatgtggacagtttaatgggcaggtggatggaaagttaaatggaaatgaagtgtgatggttagatggatagagagtggaatggaagtgaagaatctttagcattgcctaaaatacctgagtcagcctcactaatatctgtcagcttaggtttcttctagaatgagtggaggagctttactggataagctgacttctagctggagtggataatgagactagagtagagccacccagtcaccaaccatccactggtagtcagtgatgtgaatactcctgaatccccctgactccccattctttagcacccttgccacacaggaacccacttataatcatgatctacccatctctcccttcctgctaccatcaaaacctgctgtcagggaaaattctgtttagggtccaacaaagggtaaattacttattaagaaaattttttcttttagtaggatttcattagaaacacaagtagaatttcagccatgcacacaggaggttttgggtgaaacagatcttccccttgaccctgaaattaaactacgtaggtgatcaactacttttttgttgtgatgagtcaatgtcaaagactagttctgacaaaagttagcagtccacagtctttaaggtaagtgttttaacttgaattccttctggatgactcagagcttctgctgagtaaggatagtatttttctcatctctgtatgctcattgcccatcacagagcctggcacagatatgccacttaatgaatgttggatgggtgaatgagtagataagtggtggatggatggatggatggatggatggatggatggatggagagatgggtgaatagtagatggatggatggatggattagtggatggtggatggatggagggatgggtgaatgagtggatgcatggatggatgtagatggatggatggatagatggataggtgaatgagtggatggatggatgataggtggacagatgggtggttaggtggatagatggatagatggatgactgggatttcatggtcccaggcttctagacttcactgtttccccagcggtgtcttgctgctctccagaacattcttagaagtagagtaacaggactattcaagacacacatacaaaagcttttggactctcagaagtccaaccttgactccagaacttcctgagcagcccagcagaaggatagagacccacaaaagtgcccaggttgacctcaaggatgaaagaatttgcatatccaagggatttagaagtcagagagctaccatttggattttttccattgcagatgacagaaacactatcaaaatggcttaaacaaaacagaattcatctgctcacttgactaaaagattcaagaatgagtgacctcagaccccttcaaatgcaaaactcaagacccatctttaaaattcaatttatttctctgaatccctggactctgtttcctctcctttggcttcgtttgtaggcaacatccacattcttagagtggaagctgtggaagacgtaatccaacaaagattttcatgagtaaagcattgcttaatttttaaaagataactgcctaggacagataatcaggttaaatgtattatgtgagttaatgtcctttaaatattttgagttgtttcttcctgagttacttgcagccaaaagcgctccaactgatatagcacataataaatagcattactagttttttttttttcttttttttcttttttttttttgagacagagtcttgctctgtcacccatgctggagtgcagtggtgtgatctcggctcactgcaagctctgcctcccgggttcgtgccattctcctgcctcagcctcctgagtagctgggactacaggtgcctgccaccacgcccggctaatttttttgtattttttagtagagacagggtttcaccgtgttagccaggatggtcttgatctcctgacctcgtgatccacccgcctcagcctcccaaagtgctgggattacagatgtgagccaccgtgcccagccttttttttttttttttttttttttttgagacagtcttgctctgtcacccaggctggagtgcgatggcatgatctcggctcactacaatgtccacctcccaggttcaagcgattctcctgcctcagcctcctgagtagctgggattacaggcgcatgccaccatgcccagctaattttgtatttttagtagcgacagagtttcaccatgttagccaggctggtctcgaactcccaacctcaggtgatctgcccacctcagccttccaaagtgctggaattacaggcatgagccacagcacctggccaacactttatattttttaaaatgcaactggttcttgttttttggttggtggtggtttttggtgtttggttttgttttggtttggttttgggggatttttgtgtgtgtgcgttttctggttttgattgttttttagacagggtctcactcttgttacccaggctggagtgcagtggcacagtcatagctcactgtaacctcaaactcctgggcttaagcgatctccccaccttaacttctggagtagctgggattacaggcatgagccaccacacccagctaatttggttttaaaacttataaaaaaatactcaggccagacatgatggctcacacctgtaatcccagacctttgtgggggccaaggtgggaggatggcttgaggccaggcgttccataccagactgcaacatagtgagaccccatctctacaaaaaacaaaaataaaaaaattagccaggcctggtggtacacgcctgtagtgcacgctactcaggaggctgacgcaggaggctcacttaagcccagcagttcaggctgcagtgatttatgattatgccactgcactccagcctggatgacagagtgagaccctgtctctaaaaataaaaataaaatataaaaaaatgtcagtgcagtggcttacacctataatcccaacacattgggagccggaggcagaaggatcacttgagctcgggagttcaagatcagcctgggcaacatagtgagaccctgtctccacaaataatttaaaaaattagccaggtgtgacagcatgcacttatagcccaagctaccagggaggctgaggtgggagaatcacttgagcccaggaggtcaaggctgcagtgagctgtgatcatgccactgcacaccagcctgggtgacaaagcgagaccctgtctcaaaaaaagaaaagaaaaaagttcaacctcacctataacaagagaaatgcaaatacgttcattgtccacattagttggacaaaaatctgagagtttcatgactcacggtactgatgaagctcatatattgaaaacgatgaatggattacctataagagcacctttttttaaatttttttaattttttatttttgtagaaacagggtctcactatgttgcccaggctggtctcaaacccctggcctcaagtgatcttcccgcctcagcctcccaaagtgccgggattacaggcatgtgccatcttgcctggccctataggagcatcgtaaaggtcagatgtcagttttggagacttctctgtcaataacctgtggccctcaggagcttgtttccagccttggtttcccccaaacagcatcactagccctttctctgtgtgccccacagcattgggtaaaggctgtggccatgtgggatgtagcaagaaagacccttctctgaggccccattgtccaacacaaggtggtctcagtggtctgagagccagggacccctgggaaaatcctgttaacaagtttcaaagaggctggaatatatccactcatccatgctcctacagctcacccattcacaattttcagtgtgatgaaggcactctcccacctgtcactcatatgtctgatttcatcagcctcctgtaagcagctgcattccttaatttcttttgagaccaagtctcactctgttgcccaggctggagtgcagtggcatgatctcagctcactgcaacttctgcctcccgggttcaagtgattctcatgcctcaagcctcccaagtagctgggactacaggtgtgagctaccacgctcagctaattttcatatttttagtagagatggggtttcactatgttggccagggtagtctcgaactcctgacctcaggtgatccacccgcctcagcctcccaaagtgctgggattacaggtgtgagccaccgcacccggccccttcatttcttttgtatccttttaaagtttctttatggaaatatgacaatatatttcttatttcttcttcattgttacacaaagggtggcatgtgccattggctttttttcacttagcgatgtgttttggaaatagatccgggttatgcacaggtctgttatttaccaggtgctcgtttcaacttctggatgcagaggtgaaaatgagcagatgaggtcccgaccgtcacaaagtgcagggaaccggactgaaagcggccctattgacactgggaggtagcctttgccgccagtcagctgggtcccacaagaaaaaaggttttcgccagccaggagcagggaaccagcacacaccccaggtacaggcttcattcaggcttgagccacaatctgtgtccccttccaagatctgccttgaggtcagcaggagaggaggggtcgtatgagcctccgcagggaggggaaggtggctcttggaggcctactttagccaacttcaagaagacctgttgaaaggggtcccaagaagaacttcttgacagagatggcagtatctctccagggaacattcaggggccataaaggggtcttggtgcttgcccaggaggtaaaatattgaggatctttttgctggctgagattttaacttttagggcacacagcatggtactgttagctcaaagaaggaggctgctttcttccccagtacagagtcacttcagacagtgcctggagtccggaagcaagcattgggctgatgcagtgcagactcccccgaaaagcatttgctgtggactcgctggtcacctctaaggaggtgacacttgaactcagaccagtacaacaagaaaggccagggacagcattccagggagaggtgcaggaaatacacggttccaggcaggacaaaggaaggaaaggaagccggtgtggctggaggccaaggccaaggtcagagggtgcgagcatgatagggcgcaagggcaaggcccggccagatgtcgtgggaccctattcattttggattttaaattgtattctaaatccagtgacaagatatcagaaggttttaagcagggtgcttaaaaccaatcaggttttaaacaggagggtgctgtgatatgattgatattctcaaaatcaccctggctgccatggaaagaatggctagaaggggcaggatgaagcgtctgggcaagggattccttcatacattttaaattttttttattttataattaatataaagtctattgcacaaatctcaaatctcaagtatttttacgtatgattatgctgggataattacagcacccagatcaagatggaaaacgtttccaggcaaaaggctggctccctcgcacccctgcccagtctatatccgcattccatgactgttccggttcctgtcgctaaggtagtttggccagatctagaacttcatataaatggactcagagcgtaatctttggtgcctggcttctttgactcagaatgtttttgaggtgtacccatgttgtggcacggacctgtggttcattctggcaagaggagaattcgcgttaaaaacgatggaccatttttccctaatattttgagccccatgatgcaagctcagcgcccgagaagctgtgctcatctgcaaccaccagggggcagtgcggccccacagctgacccagccgcccgcaggtgccacttgaagtgggacccggaaagagcaataacgcaagccttccgagaaaggattctcaaggcgtctgctttgggctgcgccgggctacagggattgctctgatgatactgcagcaccgtcgacgatatgttaggcccaagaggtcatggtaaggtgaccttctacagtgaccatagtggtggcctcggttgacacaatgtctatgcaggaggcagatggacgctgtggtggcctcgagagtggcccagccacctacagggctgggaaacgctgttcctgcactctgcccagctttagacatgggccgcgccagtgtttaataatgtaattgtaacaatggcttcaattgtctgggagaaatgttaggttggtaggttggttggttggttggtttgagatagggtctcactttgttgcccaggctggagtcaagtggtgcgaccgcagcttcctcgacctcccaggctcaagtgatcctcctacctcagcctcctgagtagctgggactacagccgtgcaccaccacacctggctgaattttttgtattttttgtggagattttgccatgttgaccaggctggtctcaaactcctgggctcaagcaattcacccacctcagcctcccaaagtgctgggattacaggcatgagccaccgagcccagccggatttatttttatatcctgaagttcatctgagagtgatgataatccggctctagccaaatgctgattttataattcaaccatttggccgtgtgcagtggcttacacctataattcccagcattttgggaggctgaatcgggaggatcgcttgagccccagaagtttgaggctgcagtcacaatcacatcactgccctccagcctaggtgacagagaaaggcaagaccatgtatcaaaaatctcaaaaaaaggctgaagcaggtggatcacttgaggtcatcagttcgagaccagcctggccaacatggtgaaaccccgtctctactaaaaatacaaaaaaaattagctgggcatggtggtgcatgcctgtaatcccggctactcgggaggctgaggcaagagaattgcctgaacccaagaggcggagattgcagtgagtcgagatcacgccacttcactccagcctgggcgacagagcgagactccatctcaaaaaagaaaaaaaaataaattcaaccattaagtatttggtatttgtttggggttttggttttattttgagacagagtctcgctctgtcgcccaggctggagtgcagtgacatgatctcgtctcactgtaatctccgcctcccgggttcaagcgattcttgtgcctcagcctcccgagtagctgggactacagacgcatgccaccacacctggctaatttttgtatttttagtagagatggggcttcgccatgttggccaggctggtcttgaactcctggcctcaagtgatcctcccgcctcagcctcccaaagttctgggattacaggtgtgagccacagcacccagccaagtatttggtgtttggtaaactccagctctaggtgacgggggagcctctttgcccttgcatcccctacccaactccatggggatctgggcccacagagacctacccacctctccctcagcccctgaagtctactggcccccttgtggggtaataagaaatgcatattacatattacatcaagacccagtacagcacatacatatgtgtgtgtataaataggagtgtatgtatatcatgtatgtgtgtataactcagtttcacaaagcaatgcttaccaaacaactgtgacacattctataatttttccatcctgctgtttttcagtgatgcaggttccaatctgcaaaatcaatttcacaacccatggattggaaaccactggtttagaacaaggattggcacataagctcatccaagtgattgtttttataagccccatttaacagagggtgaaactgagactcaggaggtgtcgtggcttgcctgtgattcacagctggaggcgggcagagctgagactccgatcctgcactctctgactcaggttgcaaactctggtccacagatacattttattactcttcacatgatttttttcatactttgacccgattatataaaacttgggtgatttcactcaaaatgtaaattttcaacttctctaaaattcaagtggatcccttggcctgcatttgcacatgagcagctaaagccatcccatggccacccctgtgagctgactcgggggctctccaggttgacccgttcgccacagtcctcaccatgctgtgttttttgtttttttaatttttttttcttttttttgagacagagtctcgctctgttgccaagactggagtgcggtggcacgagcttggctcactacaacctccaactcctaggttcaagcaattctcctgtttcagcctcccgagtagctgggattacagacaggcaccaccacacctggctgattttttgtatttttattagagatggagtttcaccatgttggtcaagctggtctcgaactcctaacctcaggtgatccacatgcctcagcctcccaaagtgctgggattacaggcgcgagccaccgcgcccggccaccatgctgtgttttctccctgacaccccgaagtcaagcatcggttgccattgatccacacaccagccagctgttattctcatagtggagaaatattttttctgtcaaaagtggaaaaataaaaactaaaccaaagggcttacatatttcaagaaaagcaatggtggaacacggtggctcacacctgcaatcacagtgcttcgggagactgaggtgggagaatcatttgagcccaggagtttgagaccaggccgggcaatatagtgagacccccatctctacaaaaataaataagtaactgggcgtagtggtgtgcacttgtggtcccagccactcgggaggctgaggcaggaggatggcttgagcccaggaggtcgaggttgtagtgagctatgattgtgccactttgcagtgagctatgattgtgtcactgcactccagcctgggcaacagagggagaccctgtctcaaaaaaaaaaaaaaagattaaaaaaatgcacagattattcaaacacgtgtttttgttgttattgttgttgtttggtttttggttttttgagacgaagcttcgttctttctcccaggctgtagtgaagtggcgcgatctcggctcactgcaacctccgcctcccaggttcaaacaattttcctgcctcagcctctcaagtagctggaattacaggcactcgccaccacgcccggctaatttttgtatttttagtagagactgtaatgcctaagcttgtttttactaaccttgtttttagactctccctctttcctttaatcacctagccttagttccaccttaattgactctcccttagctaagagagccagacagactccatcttggctctttcactggcagcgccttcctcaaggacttaacttgtgcaaactgactcccagcacatccaagaatgcaattcactgataagataatgtggcgagcaatatccgcagttcccaggaattcgcctgattgataacgcccaaaaaaagccccgcgtctatcaccttgtaataatcttaaagcctctgcacctagaactgtttactttcctgtaaccatttatccttttaacttttttgcctactttatttctgtaaaattgttttaactagaccccccccctttctaaaccaaagtataaaagaaaatctagccccttcttcaaggccgaaagaactttaagcgtaagccatctcttagccgccggctaaataaacagacttaattcgtctcaaaagtgtggtgttttctctaactcgctcccgtgcaacaagacgggggtttcaccatgttggccaggctggtctcgaacttctgacctcaggtgatccatccacctcggcctcctaaagtgctaggattacaggcgtgagtcaccgcgcctggcctctaacatgtttactatacaaagaaagcatatctatgtcagtgttaccccagcctgtttccctagcttatatcccctgcctgggtcctgggagcaaaccccagctgaactcactaccctatgtctacgtcttgtctcttttgtccacagttgtgtccccagcacctgaaacacagcccagtgaagagtaagtccctagttaataattaacttgtggcttttatacaaaagtttctccaatgatgacaaagatatagtcatggttaagagcaggcattttttgggcggggcgcggtggctcacgcctgtaatcccagcactttgggaggccgaggcgggtggatcacaaggtcaggagttggagaccagcctggctaacatggtgaaaccccgtctctactaaaaatgcaaaaattagccaggcatggtggctcatgcctataatcccagctacttgggaggctgaggcaggagaatcgcttcaacccggaaggcagaggttgtggtgagccaaagttgcgccactgcactccagcctggacaacaagagcgaaactctgtctcaaaaaaaaaaaaaaaaaaaagagcaggcattatttgtgtcattagactgggttcaagtccagcttcggctacgcacaagctgtgtagcctcaatccctctggacctgatgtcctttgctgcaaaatgcaggtcattaggatgcaatgtgcagaaattgcctggagcacaggaggtgctgtgtatgtaaatgaagtttccctctcgggttcatcaaagtgaaccaaggtcagtactcagctgtcttaataaagcttgtagtacccaactggcccaggcttaggctatctgtgggaccaggaaggccacagttttccattaacaccacaatctgaaaagagtgccctgggcagattagagccctagaccaggtggcaaagccacgggtttgatccctggtcacatgtatgagaactggcttgttcaacatctgatcattcttctggggtggttttctgaactaaactaaaaaccggctgggcccagtggctcacacctgtaaccacattactttaggaggccaagatgggaggatcacttaaggccaggagttctagatcagcctggcctataaggtgaaaacctgtctttactgcaattaccaaaatcagctgagcatgatggcacacgcctataatcccagctactcaggaggctgaggcacgggaatcgcttgaacccgggaggcggaggttgcagtgagccgagatcacgccactgcactccagcctgggtaacagaatgagactcttgtctcaaaaaaaagaaaaacaacttattcctcaggctctattcagccaggcgtctgatatattcaaggttccacccatcagctgcatttggtacggattaagtggggagaaaagtgactgcacgtggcggtgtggaccagcctagggccagcgtggttgtggcctcggtgcatctgtttctttgcagcccagtcctgcacggtggcttcggtggcttcctggaagctcagacctcatggctttcttcagccctccatgtgagtccggaaatactgttttgggggtttgtttgtttttgttgttttgtttgtttttgttcttttgttttgtgtttgtttgttttttgagacggagtctagctctgtcgcccaggctggagtgccatggcatgatctcggttcactgaaacctctgtctcctgggttcaagcgattctcctgcctcagcctcccaagtagctgggattacaggtgcctgccaccacgcccagctaatttttgtattttagtagagatgggctttcaccatgttggccaggttggtcttgaacttctgacctcaagtgatccgcctgcctcagcttcccaacgtgctgggattataggcaggagccaccgtgcctggcttgtaaatactgttaatgcatcagtgagattgagcccatgagtttgggagcagtcatgcacagatgatgggtattagatcttacataattgtgggaggagctggggaagcaggggtctgaggagagatctggagtcaccaagaaggtgatctgagaagctgtggggcaagttcagaggactcaatggggatctgtggcctctgcagtccagcggctggtgacaggccaggtgctgacatgcaggagtcaggaagatgacctggacgcagagtggaggagagcaagggcaagctggagcctgctggcgccactgcagttgtctgtcccacatctaactacagcgaccttgcaacagtagaggctgtggcttccttacagccttggaaatctcacacagctcctcttttggtcaactctaactgggaaccactcgagagccaggattctgggaaatgtggttccagcctagccaggttggcacggaactgaccagtacacttactaatgccttgtgcttaaactggttgggtgaattctgctctctacaactgaccaggctgacagagaccttggacagttctgcagtgggtactgtcatcgttttgtccacacaagaccttttgtttgaacactttcccaacttatgagtctgcaccagaagaggcttgaatctcactttcccagcctcctttgcagttagaaggttagctatgtggcctaggctcagccaatcacatacacccaggtggcacccaggctcagcaatcaaatacccctgatatggtttggctctgtgtccccacccaaatctcatctcgaattgtaagccccatgtgtcagaggaggtgcctggtgggaggtgattgaactgtgagggtggatctcccccttgccgttctcgtgatagtgagttctcacaagatctgatgcttaaaagtaaggcacttccccctttgaactccctctcctgccaccatgtaagacatgctttgcttcccctttgccttctgccatgattctaagtttcctgaggcttccccagccctgcagaagtgtgagtcagttaaacctcttttctttataaattacccagtctcaggtagttctttatagcagtgtgaaaatggactaatacaacacctaaatggtgcttaggttcagtcaatcagatgcacccacatgggacctgggctcaaccaatccagatacatccacatgtgaaagcaatggaagtggattctgatgcatggaatccaatctggcaaggaggcagaagggtcgtgcccagcgtcactagagaaagtcgcagtgtttgaacccaatggggcagtgatgtgggaagtcttttttttttttttttcagacggagtcttgctctgtcacccaggatggagtgcagtggtgcagtcaaagctcactgcagcttccacttcctgggttcaagtgattctcctacctcagcctcccgagtagctgggactacaggcgtacaccaccatgcccctgctaatttttgtatttgtaatagagacagggtttcgccatgttggccaggctggtctcaaactcctgacttcaggtgatctgcccgcctcagcttcccaaagtgctgggattacatgcgttagccaccatgcctggccaatgtgggaagtcttaacacaaaggtcctgcaatgtaatctggacattgttggttgctgtgcaatctcctaatccatctctctggccttcccagggatttgtgagccactcaatatcctttaacaaatgccttttctgctcaaattagctggagtgcattctgttatttgcaactaaaaacctgacccctcccaattcatgtatcccccaagtgtccgtttcccgagctgcacagagtggaataaccaccccagggcagctaagagaagcctggggagtcattttgtaaactcaccacggtgtcacacacacacacagggctagttgtgactggggcagtgttgcctgatgattcactgaactggcttgggaagtaagcagactggtttgagtcccggctctgcagtgaccttttgtgtgatcttgagcaagtcacttttttctctctgaacctcagctgcctcactgggagaatgggcctgttacgagggcctgctccatgtagggagttattacaaaacccgaaggattacagcatggaaagcctcagcacagagccccacgtggggcaggcccacatcagcgacacttggaggaatataggtgacctttgcttctctagactaaagaaaataaataagaatatagatggggtcctgatgtaccctgatatgaaggtggcagctaaatgctgacctttggaaaactcaactctgattatcgccactcgactgtatagtttaaaatggacggtcggccgggcgcggtgactcatgcctgtaatactaacactttgggaggccaaggcaggtggatcgttgaggtcaggagtttgagaccagccaggccaacatggtgaaaccccgtctctacaaaaaatacaaaaattagccagaaattgcttgaacccgggaggcggaagttgcagtgagccaaaatcgtgccactgcactccagcctgggcaacagagtgagactctgtctcaaaataaaataaaataataaaatagacaggcacactggctcacacttataatcccagcactttaggaggccaaggcgggtgagtcgcttgagctcacgagttcaagaccagcctgggcaacattgtgaaaccccgtctctgcaaaaaaatttaaaaattagttgggcatggtggcgtgtgcctgtagtcccagctgctcaggaggctgaggcgggaggatggggtgagcctgggaggcggaagttgctgtgagcagagacgtccctatagcactcaagcctgggcgacagagcaagaccttgtctcaaaaaataaataaataaaataattgggctcagtcccctcggaaagaaacccccttcaggttctactgaacggtgagcccctcagagagggctcccaatcacatcatctccctacccgcctagctttatttaccttcagcgcatctagcccgcctgggattatattacatgcatacaggtatcaaattgcttcccagtgagagtgtcagatcaataaggacagagaccgaacctgttttgttcactactgtgtcactactgaggacttgactcatacagagagctcagtgaacagctgtctccggaatgaagggttttggcccacgtgctcgctgtccccagtgggccagatctctccacaggctgcagttttgcctatggccaccagatagcgagcttgctggactgcatgaaaaggtctgagccagttcctgccccggtcattgccaaaggaaaccagcaaggaactggcagcttctgccaggttcaccagacctcactgcatctccctcttcttctcctcattctgaaaacactcaacccagactggaaccttcaagcccctcccctcctacctggcctctcactgacccactggtgtggcctgagaagtaagcagattagagagtgttctaattaggtggagtggattctgttatttgcaactaaaaacctgacccctccaaatgcatgtaacccctgagtctcagttttccaagctgcacaaagagtggaataaccaccccactgggcagctaagaggagcctggggagtcattttataatggtgctcactgcagggccgtttgccgtggccagagtttggggacaatctcaatgtccaccagctgggggctggccacatgcattatcccgtgtccacatagcagatatcacaccccctaaaaatggatggaggtgctcttgaactgcactgatatggatcaatactcaaggcttcagattaagtttaaaaaaaaaaaacggggcaaggggacagggcagaagagtgtgtatcaaatgctatcatttatgtagaaaaagggggccgggagcagtggctcatgcctgtaatcccagcactttaggacaccgaggcgggcagatcacctgaggtcaggagttcaagaccagcctggtcaacatggtgaaaccctgtctctactaaaaatacaaaactcagctgggcattgtggcgggtgcccttaatcccagctactcggtaggctgaagcagaaaaattgcttgaatccaggaggtggatgttgtagtgagctgagattgcgccactgcactccagcttgggcgacagagcgagactccgtcttaaaaaagaagaaaaggagcagagaaaaatgtctctgcatttgtttgtaaatgcagactctccctgaggactatgtgggaagggggattggaggggaccgaggtagcagggagggagaggctttatactatgggccctttcgtatcttcagatttgagtcatgtgggctgttttacctggtcagatgaatggtaaaactaaaagcaaccatttctctatcctcgagtaagcaagccacttccctagatgtctttgcttctaagggaggttgcggcagaggctggatgggggtgcagtgggacacctcaaggtggcctctgcatttgaatgctgcgctgctggctactcgctacttaggagcccagctgctggctgctcgctacttaggagtggcatgaccttcattgtgtccaagccctggggacacagcagggaacagagaaagcacctccctcacccagctcacattcaactgggacacacaggagaagtaataaaaccccacaccctttgctcagagatatgaagaaaatattgagggcatgatgggcccgtgggcaggtggctatttcaagagtgacatctgaagaatcaggtaccagccacagaagagggtatcaggtcaaaggagcagagagtgcagttgagactagaaaggcaggagctgaaagaagacaatggatgacccctcgtagccatggcccctcctttctctggtcttcaggatgaaatgagacaacagaggaaaggtgcacacacatgcccaggaacgggaagctaacattcttctcacttaaaaaaatgacttggaggctaggcacggtggctcacacctgtaatcccagcactttgggaggctgaggcaggcggatcacctggggttgggagttcgagaccagcctgaccaacatggagaaacctcatctctactaaaaatacaaaattagctgggtgtggtggtggatgcccgtaaccccaactactcgggaggctgaagcagaattgcttgaacccgggaggcggaggttgcagtgagccaagatcgcgccattgcactccagcctgggcaacaagagcaaaactctgtctcaaaaaaaaaaaaagacttgggaggccaaggtgggtggatcacctgagacaaggagttcgagaccagcctggccaacatggcgaaaaccccatctctactaaaaatacaaaaattagctgggcatgggtggtaggcacctgtaatcccagctactcgggaggctgaggcaggagaattgcttcaacccgggaggctgagtttgcagtgagctatcacaccactgcactccagcctgggtgatggagactctccctccaaaaaaagaggagagtccaggtgccatggcttacacctgtaatcccagcactttgggagtctgagacaggcagatcacttcaagtcaggagttcaagcccagcctggggaatatgtgaaaccctcgtctctaaaaataccaaaaaatgagccaggcatggtggtgcacatctgaatccccagctacttgggaggctgaggcaccagaattgcttgaacccaggaggcggaggttgcagtgagctgagattgcgccactgcactgcagcctgggtgacggggcgagaatccgtctcaaaaaaaacaaaaaatgagaataacttgtagacagtctgtcttcctgtgaagaatgagaggcccaccctgacagggctcctgtgccctgctcaccatctgtccccagtaactgaaactgtgcatggctaatgacaggtcccctgtaatacttgagtaactgaacgattgttgtccccattaggatgcaagtttgatgaaggcagggacccgactccttgatggcaccatgggatcctcagtgcctggacagtgcctgacgcgatgtgtgtttgctgattggcaggaatgaacttatgcccacgcgggccaacctcccctgccggccatgtcatgtcttggcccttggcacaggaaggggtttgtggagatcttttctggggagttactggattgcagagaaggaacactgctgcccaggaaaccaaacctcagcctttcaagccggcttcattctactcataccctgtgcacctccagccaggcccagagccatggaccagggcacctgcgaggggctgggatccttgctgcccacgcgaggcctgttagctcggcctccctacgggcttcaagaagacaactccgtcctctcccaactgtttgacgaggactggcgtggggggcacccactagggcccattctctccagtgtgcccaccacctggctgtggggggtgttcatgacctctcacggccccttctgtgtttggtcgtgcaaacctgacacagccatcccgaccaaatggaaaactgcaaattcgaggacgaccacggcatttttccaaaacagtttaattaaaaaaaggtaaagaaatctgaaaaaactgggggggtgggggaaggaacgggcaaacccaaaaaagcatatagtgtgagtctactggctcagtcacaaagaaacaccaccatcaaaaagatatttaagtttaatacaaattttatacaaagaaaatgtgaaaaaatacttccatatgctaaaagcaattatgcttcacaaataaggccagctaggctattttttttttttgacaactgcaattcacaaatgttctttctctcctgttttcttctaatactctcttatttcttctctaatatgggtaactagctggaaactgtacagttcgcatcctcttaacaatgaagagaaagtaaacaagactaaaatgtacaacaaaacgtactggaatgatatcgtacaattaattttctcatatacatacatcaccttttgctttttcatcaatgctttttgttttacacaacatacaaaatggctctacagcatacgtagtgtacggacagcatgacgggccttgctttctctcatactgcctgtgtttcatgcttacataaaaacgtgaaattccatcatataaataatacgtacatgcttcatcccagactcaaacgtcctctgcgtgcaccttgcctttgagtccttgcttccaagaagcacagcatctctgaccaagtgtgtgtgagtgtgtttaaaggaaccacaaagcaaagataaggtttctctttttttcagagttcatgatcctaagactttctgtgttctctcctgtgactgagctgagtggggcttgtttgtttctcttctgtaaacaaggatattgttttttcccttttaggagtagagtcatcatttcaatcacatgaaagaaactagcttctccctgtgtccgtctggtccggagagcttgcgttttaggaacgtggtaacgtagtagctgaaaggagccaacggcttgatgggatagtctgtgccgaaactcccgatcccaacatgctgcgtacagacacacgagcgaaaacggttcgccctcccctgggtatccaaggatgaggacgtgagtatgaaagtggtccccgggcccagtatccattccgtcgtgtgacagacaggctaactgaccatcccttctccaataccaaaacattcttttttgttgttggggttggttgcttttttttttttttttaaatcgtttttctttttctttttttttttttaataagttaaagttaatacaaatataaaaaggggaaagtcctctagattcaatgacatccacaaattgtacattatttacaccaaaagcacagggctcgtgtgggtgaacagtctgcagtcaaagccgatgctgggtgtcctgtagtgtagcagcccccgcgccgggggctcaggctcaactgagggttttgtcattttcaagtctgaaagtggctgttctcctgcctttgttgtttcttcttttcctggcgtctgggtttttctcccaatggggtgggtggtttgtgtcccgattcactgctagtcccagaaggtgtccagccgagactctttcgggaggaggctcttcgtgctggtactggtgttgtgatcggaacgtgtcgatcccctcttctcatcactgctgctccaactggatttattactccgggaatggtctgagggggaaaaccaatgtgtttagcgtgcctgcccacctgcgcctgagcacaactatcctgcaatctgacctgcccctcctgcacaggaaaccaccttcccctcccaattgatggttcaaacactgccaccgctgactgccctgcatctgtgggtctgtagaacagaaaggtagaacaacttattttttaggatttaacgacaaccggttgaaaaaacggtagggtgtcatgctcacagagaataaagatttgtagaaaaggtgctgaactgccaaggaaggcatttcttgtgccgtgtctggaaccgtgtatccttactacatcactgaacgacaccaagcaccccatgcacttctgggtccaaccttggcccctggagaaagacactgaaatttggcatgcagtctacttccgttagtgggatttcttttatcaatgtataggcaacttgaaaaatggccttacaaccaaatcacacttgtccacccaagggaaaggatcataaaggagaagaatggttaagtccacctgggaacacacacccactgactcccggtaaggacaagcttatgggtgactgaagaattcagaatcagaataagacctaggatggcttcaaggacacatggacaaggagctgagtagtgactgagtaagaaataagtgaagaagctgaaggaagagccgaatgaggtgtctgtgaagagcactttagccaacagcccagcccagatctgcagctctgctagatggctgactggagaaaccttccagccaagccctaagatcccatcacatcctggatcatgtactaagttcagacagactgggacagaattattttttaatttcttaaggtgggtgataatgtttggttgaaagaggttgagggcaagagtggagtgggccaaggaggggaccatgctactacctaggggggctgcatttcttactgcctggtaaaaaggcatgtgtgggtaatcatgagttctggaagataagcagtgaagagaatgacaaagatctccaaagtcatgtagttactcaggagagaactcttcttagtcatgtgcatcagtgaccaaaagggagcaatactatggtaggcagagctgggggcaagggcggagtcttcttaacaatcctcaatctgccttcttatgccttcttcccttagccgccatgcctatgcttttatttctccggaaggactctggggagtgatgcagctggtcatccccatctgggagaaaatcctacagtgatgtggtcaaaccacatcaagtccttccagctctggtgagggcagagaccaccagcgggtactggaagaaatgggaccagggccaagctgagttcagtatctctctcccagaaccaggctggccaatggagggatctgcaggccctcactcctcatatggagaggacacgggacactggctgccatagccaatcaccacaggagggaatcggtgttcatctaggaccctttatgaaaagagcgaggacgatctccatcaagaagccaggccacatgctcgctctcatttcctaatgcagtttgtgatggcgaccagaggcacagcgaagaagaaacgttgcaaaggaagacccacaactcaaaagaacaggagaagacacacccacaaaggaacacatacacggacacacacagaacaagccttctgcataccaggaagaagccccggcagctttcgtaagacaggttcatacttacacttctgggcggggtagttggggtgcggctggtggtctgtggtggttggggcataggcaggttgcttgtcacaccttttgctaactgaagagatagcacaggtagcctcagagtctgtcagagagctggaattccgcacaaccccaagtgcttactatttttgttcatcaacaggctactgttattagaaccagttggcaccttcattcatgtcaccattgtccaactttaatgcaagcacaggagactaagtctctttaaaaatgcatatcaaaccacaaacagcatcactggacacagcacagcattacaggtaggaaataaggtatacaatgacataaaagcaactcagcattttgtaagccacaaattttcaaccactagctctgccaatagcctaattcaaccatgggaaacggaggcaggcactagaaacgtgctaaggttgaaggcagcacccgagaaagccagacaatttaaggcaataactcatcaactgcccacagtgataacagaatagggaggagaggatggagaaggcacacgtgatgaggaggactaaggaaggggctccagatgaggtggcaagtaagctaaattctcagctacgatggtagcacaccaacaaatcacctctgaaatcagagtcaaaaaacagtgatatgaaaggagtctccgtaaacagctgataccgtgagaagcttcataggaaaacaattgaaagtaagatcaagagaaaaaatagaaactccaggaaaaaggctataaaagaatggaatataatcacagtacactatgtgactctgccatgaatgatatggtcataatcatacaagaaagaattgtcacactgcaactttttagactaagccaacagacaagagtgaggcttaactgcagttataggacagaatgcacatgttctcaaccttgacaacggggaaagtcacaggacaggtgggaagcctggctatgacaggggtgggagaggtaaggagaagatggactgccaaaagaggggtcaagagatactgtctgtagcagacagaacaaaagagctaaggaggcaagtgtttcactggagcaaggtagcacataaaatagcaacctcagtagtgtgggaagaggaagagaagagtaactctcatcttttaaagctcgaagtcaacaaataatatctaatgatgaagtcaagaaatagaggtatagccaagtacattatttattagtaaggaggtaacagaaggaccagaatgagccgtgtaaactggaactaggaagagttttcccctgcactattttattctctgcaactctatgcatatagctctaactaaaagcttaaaacgaaaagatgaacaggagaggcccacacactaagggagctcatacccctaactaaaattctctctcttccaactaaacttagatgtactgtcctagtacctgatgcacataaatagctcagaagccttgacgtttttaaaacccatgttccttctagatatgtcacgtgcgctgtcaccagaaagcaagtgctggcagaagtaaagtgacatggatgaggaattaattagaaggggatcaaaactgaggaagtctttttgctttgacgtgacctgtcaacacaaactgctttggtgagaaaatcgggaagactgagaagactgacggctgcattcccgcacagacctctgcggcctccctgcagcttctcactcacactctcagaatcactgcggcactgactgcaaaacgcactttttctgccactttctgaccatgggctccatggcgctctcactgtgctgatgtgactctgcccagcctctttccaagtcctaaatgtcggactaaatctcttgtttttgagacacagtctcactctgtcgcccagactggaatgcagtggcacggtctcaactcactgtaacctccgcctcctgggttcaagtaattctcatgcctcaggcccctgagtagctgggattacaggggtgtgtcaccacgcctagctaattttttgtacttttagtagagacggggtttcaccatgttggtcaggctggtcttgaactcctgacctcaaatgatccacccaccttggcctctcaaggtgttgggattataggcatgagccaccacgcctgacctaaatgcggggctaaatctcttttagtgtagccccgggtgcacctcaatctttatccaaaccctggagaggaggccctttctgacatgaagataccatgattctagccaatctggtcgtcttttaagaaaaaagtctctgctgctgaccacggtggcacatgcctatgatcccagctactcaagaggctgaagtgggagaatggcttgagctcaggccaagttcaaggccagcctcggcaacaaggcaagatcctgtctcttaggtttcaaaacaacatttagaattaaaaatgtcggccaggcatggtggctcacgcctgtaatccaagcagtctgggaggccgaggcaggtggattgcctgagctcaggagttcgagaccaacctgggcaacacggtgaaaccccatctctaataaaatacaaaaaattagctgggcgtggtggtgtattcctgtaatctcagctgctcaggaggctgaggcaggagaatcacttgaacctgggaagcagaggttgcagtgagccaagattgcaccactgcactccagcctgggcaacagtgcaagactccatctcaaatactaataataataataataaatgtccatgactgttaatggcttagggggatggtggagtatcagaatagaaactgtatcatagcagcagcggagtgtgtaaagaaagggaaatggagacaaatgaaacaacttttttttttttttttaaatatgaggtctcactctgttgcccagctggagtgcagtggctattcacaggcactcactgcagtctcaaaactcctaggctcaagtaacccccctgactcagcctctccaagtagctgggactacaggtgggccctagctctagaataacaacccttgaagagacatctaactaactgggttgaggaaggagacaggacaggtcttaagctatgccattcaatatggtaaccactacaataagatacaatgttaaattccattcctcagtcgcactagccacagttcaaggcttcagcagcgacacgtggctagtggctaccatagtggacagtgcaaatataagaacatggccattgtcacagaacgttctattggagatgcaaggtgtcaaggaaggcacttgtagatagatgaggatatttaagtgcctaggaagaaaagcaatacagagtgagaaatctggctacaacaaaggatgcagatgcctttgaacggcaggagggaaggacagagcacaccacggaggccctgcagagggcagaggagcagccctgagcgcccagggatggtgacgcagggagagatgcagggaggtccaaaacagagcagagaacttgagaaatagccatcatggacgatggaatcctgataaaaacaaaaaacttgggtcacaacacaggcctctggccaggcacggtggctcatgcctgtaatccagcactttgggaagccaaggtgggtgaatcacttgaggtcaggagttcaagaccagcctggccaacacagtgaaaccttgtctctattaaaaatacaaaaaattagttgggcatggtgatgcacacctgtaatcccagctactcaggaggctgaggcaggagaatcacctgaattgaggaggcaaaggttgtagtgagccaagatcacgcaactgcactccagtctggacaacagagcgaagactctgtctcaaaaaaaaaaaaaaaaaaaaaaaaaaaagggccgggctgggcgtagtggctcaagcttgtaatcccagcactttgggaggccaaggcacgtgaaatcacctgaggtcaggggttcaagaccagcctggccaacatggtgaaaccccatctctactaaaaatacaaaattagctgggtgtggtggtgcacacctataatcccagctactcgggaggctgaggcaggagaatcacttgaacccaggaggcagaggttgcagtgagccgagatcatgccactgcactccagcctgggcgacagagcaaagactctgtctcaaaaaagtagaataaaaaaagaacacaggtctctggggacaaaaagtattaataaaagaaaaacatattgggaagacgatccggcagaagagaatatctgcttctgaggttagtgacccagatttgcgtgtgtgatgagaggagtttgtgttcttgtgtaacattctccagttaagcactgaggctcaggtgcaggtaaatcaaaagcggaaagctggggttcatccaaggtgaggttttgccaaatggacatgctaggaaaacaggaagggcctgggagactgggttgtattagcaacagtactccatggaaattaagctgggtaaggaggtaggaaggagggaggtatagaaacaagacagttagtagaattgggtgaggaaaaaaaggccacatctgcacgctgacgtttcctagagatcagtgccttattagcagagccacgcacaagtgccattactcagccatttttgagttacaacaattttataggtgtccacctaagtatacctgacatatggttgcaagcatgagtctggattgcaaagctcaattggttgcatatggttgcaaagctcagtccttgttaaaaagagaatcaagaaatatgagagatgctaaagacatctcagtatcaaactaagcctgttcgaaggggaagtgaagagggagttgctttctcagtaggtgcttccgtcatatttaatgccaagttcgtatccttcctaaagtgagctcacgttactccctctgactgtgcccccaaatcccacccacccacctttcaaagcatgagtctggagagatctgaactgaagtcttggctctcataattactcattgagttacctgggcatctgagttaatgtctctggacctcaacttgctcatctgtataatggaaatactaactatgctcttacagacattggggaaaaacatgataaggtgttcatgctcttcagtatcaccaatagctgctcttctgacttcctttgaaactccacgaagataggcatttatctgccttattcagaaaaactgccccttcctccccctgctcgcccccctcttccccccaccatttactggggcttcttgcctcctctcccttccactccctgggccagtgtgcctcaggtcaggagtcagcaaactatggccagctcaatgcctgtttttgcaattcaagtttcattggcacaaggcacacgtttgtttacatattatctatgtctactttcacactacaacggcagggtgagcagctatgacaggaaccatgcggcctgcaaaacctaaaatacttactaaatggccctctatggaaaaagtttcttgaccctggtctaggtaatactcctccagctcagaatggaatacgatgcctctcccaactaccttcctgtatgccaccctcctgatgccaacagactcctgccagattcatcctaccacggcatcattcatcttctcagatgccatttcaatcaagccactttgaggctccaaaaccctaacagcacccctctgtctgaaacggtgtttccctaacttggaccttcctcacaccacttgtgccatttcgacacatccatagtcctcttacatattgcttagttcatgtttttattttaaacttatgtaacttaggtaaataactaaacttttattgttaaccaacaaaaaacacaaaaccaataaaatctgctgttaaatcaagggcaactccaaaaatgaatgtaatgaaaaccttaaattaaaagttctagggtggggagcatgcggctaaaatctagagtctgctcagtctttgttaaaaagagaatcaggaaatatgagagatgctaaagacatcttagcactaaactgagcctgttacaaggggaagtgaagagggagttgctttttcaataggtggttcagtcatatttaatgccaagttcatatcctccctcctaaagcaagctcatattactccctctgactgtgcccccaaatcccatccaactttcaaggcctagccccttagggaaaccgttcccagcccctaacaatggacatcacttcttcctccatgcactcaatatgcagaagtgaaatgaaatgtttgcttttcagctcaagagaatcgtcagtggctcacgcctgtaatcccagcacttccggaggcagaggcgggaggatcacttgaggtcaagagatcaagaccaacctggccaacatggcaaaaccccgtttctacaatttttttttttttttttttttgagagagagtctcgctctgtcttccaggctggagcgcagtggcacgatctcgactcactgcaacctccacctcctgggttcaagcgattctcctgcctcagcctcccaagtagctgggattacaggcgcatgtcaccacgcccagctaatttttgtacttttagtagagacagggtttcaccatgttggtcaggctggtctcaaactcctgaccttgtgagccgcccacctcagcctcccaaagtgctgggattacaggcatgagccactgcgcccggcctaccaaaatttttttaaaaaattagccaggcatggtggtgcgtccctgtagtcccagctacttgggaggctgaggcaggagaatcacttgagcctgggaggcggaggttgcagtgagctgagatcacactactgcactccagcctgggcgacagggcaagactgtctcaaaaaaaaaaaaaaatcatcatcaggcagaaaggtcctggagctgtggtgccaggcaaaaaccttgaatgaagtaaaactgtcttccaccaggaagacaccttctctgaacccttctggaatgacccaaaactgctttaagaaagtgcaggaaaaagattctttgggctaaggaaggaagacagctcaaaccccacagaagaaaaaacctagatgtcaagtctcagaaatttccccaaacctgcctgccaggttattctccaaaaggaaaggatttaacagaaagatcatccacttaagcactgccttcaattctcaaaggcttgagcgccttcatccaccatatgcaggtgtcagaacctcagaataaaatcttacacagtgtcatttaccgttctcatttccctgagagagagagaaaaaaaaaacttcccaatccaaatgcacttcttctaccctaccccaggtcagcaacagaaccctctgtccaaatggagttttatgtggatccccagtaaatacaataggtaataccgatcagcttgaagaggtacctgaaagttaacatgctcagctaccccctcacccccactgacccaccccaggcacccctaaggatccataatcgtttggaaaccattggaataaacccttcaaattctccctgacaaaatggctccccatctgcccatctgaaatgtgaaagcaccgttcgcccaccagggggcaacataccagagccttggttggagcctaagagaatggaggagggcgtctctctggagccagaaaggtcaagggtctagaaatacaaaaagaaaaagatggactcaaggcactgaggctactgtcgcccccacagggaaatccagggagtcatgggggtgctcatcgctgcccccaaagcatctcagtgtcctctgcctggcacggtcaggtgggagtgatgggcacagggcggccaggtggccaaaccccaggtaccatctcccacactgaacagactggaacgcagcaccagagtggcccctcactgtaccctagaacattcactgtttcctaaactccactcactaacagaaccccctccagatttttgccatatccaaggagaaagtacattacttcaaaattctgtcagtccgcttttaattcatgctagcctctgactaggtaatactatcagttaaaccaacatgttttaactgacagtctaacgatttatctttttcctaatatgcaatgaaatagatatacagtgactaaaaatgtaaaaaactatatactcatgaaaatagtctttgcataccatcaatgtcacatacatcacaccctggcaaacaaacaaggaggtgaaaccttcgtggcccaatagggcagccactagccacatgtggctactgaaatctcaattaaataaaattaaataaaactgtaaaatcaggtcctcggtcacactagctgcatttcaagtgctcaaaagctgcatgtagctagcagctaccattctggacgggaagtacagaacatttccatcatcgcagaaagttctcctgggcaacactattctacactttgagggtccccagcggagagtactggggagcagctgccaggtcccacacacgccggcccaggctccatgttcccacacatccactggaaatgccggcacactgttaggacaagcctcccacaacacggaactttcagggcggcagacagggggtcctaagtccacttggcacaaagggtagatgtcactagccaaaggcatggggggatcctcaccgagccactctccttgcttttctcagctgacgtctccttctctttggaggcgctggccgtttctgaaggtgctgattgtgtgctcgaggagctcccctgggaggacttatttagtgtttctgtgttcacctcagcatccgcttcctgctgaggagcagtagctggggacaaaggagagagagagacgccacatatacacagagtacgatgattttgaaacatgcatggagccccgccctgcacccagtggcacccaaggctcagccctacccagggcataaaagtggaggctcaagggggccagattgccagagttttccagaagctggaattccaaactttagaattccaaattttaacataaacatgctgagatggagtctcactctgtcagccaggctggagtgcaatggcacgatctcagctcactgcaacctctgtctcctgggttcaagtgattctcttgtctcagcccaccaagtagctgggactcaggtgcacaccaccatgtccgactaattttttgtatttttagtagagacagggtttcaccatgttggtcaagctggtattgaactcctgaccttaggtgatccacccacctcggcctcccaaagtgctaggattacaggcttgagccaccgtgcctagccaacatgttgatttttaatggttagcaattcaagttttattaaatcattctggagatgaaagtatattcctggaacaaataaagcccatcaacaagagccaacctgtaactgctgatttagagttactctatttagtcatttctaggtggagacctatatttttagccccagagactttcttccttctaaggtgggacaggaaaaccacgtgaaaggcgacatgctatcagaggcccagagaatctggagatggcagaaacttggacacatagaaaaacagggcgtttggggccgggtgcggcggctcatgcctgtaatcccagcactttgggaggctgaggcgggcagatcacgaggtcaggagatcaagaccatactggctaacacggtaaaaccctgtctctactaaaaaacacaaaaaattagccaggcgtggtggcgggcacctgtagtcccagctactagggaggctgaggaaggagaatggcatgagcccgggaggcggagcttgcagtgagctgagatcgcgccgttgcactccagcctgggagaaagagcgagactccgtctcaacgaaaaaaaaaaggaaaagaaaaacgcgtctgggaggaatttaggaagaacagatgtaattatgtcacaaaaaaaggaaagccgaaggacattttggccatcttggcaaaacagcaaaaggctcatcagacacattccagaacggagggaaaacacaaagagactttactccagtaagagaccaaaagtctctacaaagaagacatctccctaaagactaaagaacagggcaaggtattctccaatattgccttttaaaaaataataaaataacagatttgtctagagcaagagctggcaagctagtgctgcctgttttattggcagacagccacatccatccatttatatatcatctatgtccatccatttacatatcatctaagactgcttctgcactgcaacagcagagttaagtagtagcaacagaaaccacatggtgtacaaagcctaaaatattcactctcgcccttcacagaaaaagtttaccaacccctggtcaagcttctcacacttgagtcatttacataccacctttgcaaattttgccaatccgcagacatactactttattgtattatttatgggacacttgaaattctttaaaatggaagtgtttaattccaaccatacaaagctagtatcatttgccacaaataaaagctaatggtaaaaaataacttataggctgggcgtggtggctcacacctgtaatcccagtactttgggaggctgaggccggcagatcacttgaggtcaggagttcaagaccagcctggccaacatggtgaaaccctgtctctactaataatacaaaaattagctgcgcatggtgatgtgtgcctgtaataccagccacttgggaggctgaggcaggagaatcagtggaagccaggaggcagggttgcagtgagccgagatcgtgtcactgcactccagcctgggggacaagagcaaaactctgtctcaaaataataataataataattcataaaatattattgatgccaggcgctgtggctcacgcctgtaatcccagcactttgggaggccaaggtaggtggatcacctgaggtcaggagttaaagaccagcctgaccaacatggagaaaccccatctctactaaaaatactaaaaattagccgggcatagtggcatatttctgtaatcccagctactcgggaggctgaggcaggagaatcgcttgaacccagaaggcagaggttgcactaagccgagatcacgccactgcactccagcctgggcaacaagagcgaaactctgtctcaaaaaaaaaaaaaaaaggataaattctaactagatagtgcttcctgctggaagctctaggcctggggactgcttgttctatgttggaaagggtgattacaaatattacagcagtgtcaaagataggttagtaccaaactaacactttttacttaacaaagaaattgggaatccatattatctaaagccacaagtccattactgccaaaaaaaacacagtgtctcaacttcagtactactgacactttaggcctgagaagagatcaagggttctgcaaagatcaaaggttcaaaatgcccatggctcaagttttagctatgtgcctgcacactgctcacctgtgtgtaagacacaattgtttttgagtgaaagtgtccagaagccaggcaagctcccttgacaattagccctgagacccctgaagtccacaggggagaccaatgccaagccactgcagcccaggacgggaggcagccccacagggcattacctgactgggtgcaggacttcatgtgctcaggccagtgggcttgctggcaggggtagtcacagtagctagtgttccaacagcagtaaaagatggcctccttcttgcagttggcgcaccactgcttcttcttggtctcatccaccgcctgctgcttctccaactccagctgcttcttcacctcggcgatgagccggtcccgctcctgctccaggctctgccgcatctccgccatggtcagctctggtggaggaggggaagaacaccgctcatcacctgaccccagcctggggtgtggggttattcctgcccccagattcaggcagacgtggatgcaagacctggctgggagaagccctggctgtgtgcccatgggcaataacctagcccgagtcttcatctgtaaatagggcattcatcatggtgaccagatggtgctgcctgttgagagtggacatgaggtgcccagcatggacataactgcagccccagaggattttccacaccagactacattctgggaattcctcaaagtaacccttgaaacaactgccaccaaaactcactttctatcctattattcattaacataagccttttcccccctatcaatcaaatacctatacagcacccactacatgaaggcactgttctaagaactttataaatattaactcatataaccctcatcctaataatcctacggggtaagtactactattctacccctttcgcagatgaggaaaccgaggcaaacagctagctgggcctagacctcaggcgtgctttcttgtaggtgtctcctgtggcactggatccagatgggactgtggttgatgattatactaacaggacaactatgaacctactcagtctaccaagatttctctaattttacttcagacagttaagtccactggtaattcatttaggagtgacctgctggctgtaataaaagaaaaataggccaagtgcagtggctcatgcctgtaatcccagcactttgggaggctgaggcagatggatcacctgaggtcaggagtttgagaccagcctggccaacatggtgaaaccctgtctctgctaaaaatacaaaaattagctaggcgcgatggtgtaatcccagctacttgggaggccgaggcaggagaattgcttgaacccaggaggcagaagtttcagtgaaccgagatcatgccattgcactccagcctggacaacaagagtgaaactccattgacaagggaggggaagggaggggaagggaggggaaggaaggggaagggagggtaatggaggggaagggaggggaagggaggggaagggaggggaagggaggggaagggagggcaggggggaggggaggggaggggaggggatgggaggggaatggtccctcaattccttcaaatactcttcctgaactttataaagtaaaattaacccctcataaagaagttaactacctgtggccagacagaacctttgagtcaatctaactacctttaactaggggtctgcaaaccatagctaagttttggccagcccacaggtaattttttcaaatgtgcagtcaacacataaaaagaaaaggattttatgaaagtaagattccctgattttattagaaaaacaagaagtggtggcaggggcagtggatcacatctgtaatcccagcactttgggaggctaaggtgggtggatcgcttgaggccaggagtttgagactagcctggccaacatgctgaaaccccgtctctactaaaagtacaaaacttagccaggcatggtggtgcatgcctgtaatcccagctactcgggaggctgaggcatgaaaatcacttgaacctgggaggcagaggctgcagtcagctgagattacatcactgtactccaacatgggaaacaagagtgagactctgtcttaaaaaaaaaaaaaaaaaaggaaaacgagaagcaacaacacccaaatcagcgtccagaaagaatgaaccaagggctcctctccagggggctctgaaaggattcatgtctgcaaggtgtgacttagatgctgaccacaagtgagcaggtaggcacacctgggcatgggtcctcaacctaagagttctcctggctgccagcagcccatctgatctgatactacgtgaggggctgaagcaatcacttctacctttggggaaaagcttaactatacagaacgacaggccaaaacatctgtcaatctaatccagggaccaataaagtatctttctccgcactgagcagtgcacaggaagcatccagatattgttaaagtgcctagcattccatgatgaacagggtgaagagtgcccagacttgaactgtggccgtgtgactttgaataatttcctcaacacgtcggtttcttcccttgaaaactggggatatgtccacggcatgcggagtgtgaaaaaaaggaaaggaaaaccagggatataacagatccctttatcacaacagtttgtgtaatgaaattagttaagtgcactgcagccttaacttctcaggctcaagtgatcctccttcctcagcctcccgagaagctgggaccacaggagcgcaccaccaggcccaggtaatggtttaaaattttgtgtagagatagggtttcgccagattacccaggctggtcttgaactcctggaatcaggtgatcctcccatctgggcctcccaaagcgctggaattacaggtgtgagctgccgtgcctgaccaatcctcattattttattgttgaggctggtgttctgaacagaggaaaggggggctcccgccaacacccactcttacacctggtttctccaggcccagactctcaggattctgtggtctccctacgagtcatacaatcctagcctagctttaattgcactcacatctcggcttgactccagaggtgcaaagaagttcacacccaaaaccctcctcagtccagaccagtgtgtcaggccttacctaagttgtgtttcatttcggagagctcttgctggtgcagccactggagcttctctatctcgatcctcagcctgcgaatctggaagagggagagtgagcatcttcaaaagctgtctcatgcagttcaccaggagggctcagaagctcaaccacggctggctgtgaggggtatgggaatcatgctaaccttcccacagctatagtccagagaggtgatcactggtgggtgaacccaaattcaccagaaacactggttcagaaaaccaagtataaacaggccatcaattccaagaaatactggcacgagggaaagccacttaaagtgacaaggaccagactttcatataaataatatattaagggttatttaggattttggtctataaatacgtaacaaatacaaagatagctggattttcactcttacataacaacatttaggtggtgggatccacacttattcacctgaaattccaaagcctgacatctctgaaaaccaaagggtatttctgggcagaggaagtgtaactttggatccaaactcatttgaaagggcaaataaacaaacaaactcgacctgatctgataggaaactaattaaacagtgttttggccaggtgcggtggctcgcgcctgtaatgctagcactttgggaggccaaggtgggtagatcacctgaggtcaggagtttaaggcaagcctagccaacatggagaaaccctatctctactaaaaatacaaaaattaaccgggcatggcggcgcacgcctgtaatcccagctacttgggatgctgaggcatgagaatcatttgaacccgggaggcggaggttgcagtgagccaagatcatgccactgcgctgcaacctgggtgacagagcgagactcttctcaaaaaaaaaaaaaaaaaatttaatttaaaaaataataataaacagtgtttaattatcgcagtagttcttaactggggcaatttcgagtactctcccctgtcatgagaatgtctggagtcatttgcggttgtcacaattgagcagtgttgctgacagggatgctgctcaacatcctagaatgcacagggcagccccacaacagaaattatctggttcaaacgtcagtatagctaaggccgagaaaacctgattaattcacgtagtgtgaacaatcacatttcattgcagaaatggtgtctctaattgtgggggactgcatattataacctctctaaaatccaaaaaaaattctggcatacatccagaccccgggtttcaggtgagatattatgaacctgtattttcaaccacacaccaattcttacaacgtatacaaacaagaatgaagctgtttctaaagccttattctttcccttcttatttgatgtccaaagcataatcataaaggtcatacttgcaaaactattcaaggggattcattgatttttcttgggtctcttaaatctttgtattcacattgtcttctgttgaagggaccaccaggttgccttcctgaagatcttctcctcttcgtctgagcaccagcctaatgctgccaagtcctaaaaggtcaatagctctgcaaaggattcccacagctccccaacgtcaccttaaatgacctctgtaagtcctgccacttgtcatttcacctgataacccgtttgcatctggcctacattgtaccatccacagacagccggcaagtggcccactctccaagccctgatagggaattagcctaaaggggaagttcagggaggtgtatttttaaaagcggatgctttataagtagatagcttaattttttttttttccttaagagacagggtctcattctgtctcccaggctagagtacagtggcacaatcacaacttactgcagcctcaaactcctgggctcaggcaatcctcctgccttagcttcctacaggaacacaccaccatctcctgcttgtttttttaaaatttttgtagaaatggggtttcactatgttgtgcaggctggtctcaaactcctggcctcaagcaatcctcaggattcccaaagcgctgggattaccacaacttcccaaagcgctgcgattacagccaacatgcacagccaatgaaatgtcttaaccactttcttgtctacacaatcacataattatggagactccagtacacaaattattgaacaagaagaagcacttgtattaaaaagtccaaacttccagagaagattcaggagccagttttacatgaagcaaaaagaactggtgtccagtttcaccagtaggttaactgaagctctgattttggctgttttattagaaatgaattgatcacacaaagcagggcatgtctccacagccccagccgtctggctaaaggaaaaaatacccccatcgataatgacaatcagtagagccagcttagtgaccaagccaggaccccagaggggtttccagagaagcttcttcatggtaccacctttaaagcagcccacaaaacactcttagcaaataagaaattcatgtgtcatctctgacctcagctattgtgcttccagtagtgtttttagaaagatcgttgtatatttctgtcattgttccttttattgcatccatcatctgaaagataaaaacagaaacaattcagctgatcacttcttggaggcttttcctggtgacaaatacttaaaatctatctgtataaagcagaggttctcaacttagggcaattttgtcccgcatgagacactgggcatttctggttgccatgacaggtgcaggagcaaggagaaggagctgctactggcatctagagggtcgaggcagggacactgctaaacttcctacctgaaccatgctaaaggcacggaaggaccccacacaaaaaacaatgacctacgagcccaaaatgtcactagcactgaggttaagaaaccccagcattaatggggtaaaaatttccaacaaatttcatggatcgcattgtggtgccacttcataaccataaagctagtttccatacccacataaagctagtttccatactacagtttggctgaaaccggagaggccaaatttggcccccagatgtgtggtgttttttttgttgtttttttttttttaagatggagcctcactctgttgcccagactggagtgcaggggcgtgatcttggctcactgctacctccgcctccaggttcaggcgattctcctgcctcagcctcccaagtagttgggattacaagcgcacaccaccacacccagctaattttttttctatttttagtagagacagggtttcaccatgttggtcaggctggtcttgaactcccgacctcaagtaatccacccacctcggcctcccaaagtgctgaagccactgtgcctgacccccagatgtcttttatttgcccagcacagtaggttcgagagaaggattactttgttttggttttcattatttcccgtcaaaaaaccagcaccgctttattgaggtatatgcatatactataccattcattcatttaaagtatacaattcaatggcttttagtacctcagagttgtgtatctgtcaccacaatcatttcacaacattttcattaccccaaaaagaaaatcccactcccccggccttagtcttcacctcctggtatcccatcccccgctcccccagcgcctgacaaccactgatctgccttctgtctctccacatttgctcagtctggacatgtcatataaatggaatcacacaactcaaggtcctctgtgactcgcgcatccgtgctgcagcaggcagcggaacttcattcctttttatagtccatttacagatatggctggtttgtcattttaatgccttcagtcaggacactgtctttgcggttcatttcccatctttaactatctgacccctgaaggcatcagccagttggtgacatcagctaaggtccctgcagcaggcacccagggatttgctgactatgttaataggatgaatttctcttctacctcccacctgccagctgactcttcccccattacagcagaaagaggaggggacaagagatcaggctctgtctcaggcctggcttgactggtgctgagtctctccagtgctttctagatgccccaattcagggagaaggcgggacaaagagcagcctcctatctgatgcctcactatgcactgcctctaagcctcggtttccccacaaaaaaacaagaactgcatgccgccccggtagggtgtgcacgaggattaaatgaaaaaaaccacgcaaacactgcagctcgttacctgccacggagtaggtgttcataaagaaatacccattcatcttatttttaaagaaaaagaaattcatgtaagtatgcaattgcgtaattgctgccaaaccccaaaatagtaggcccaaattcaccccaaaatggagtaaaatgaataaaatctctgttgagatttccgctcccggcttgctgcggagcccacaccaggccgttgccagcaaaaacactctgcgctttccacggctttgcagccctcctgcacttgcctccttgctctgttgcacccactgtgtccattttaaaaattacaactaaatggctttacaagaaaactttaaaaagtgggtgaaattcaatacattgctaatgtaatggtcacattccacttcaaagatatcatgcattcatggactgccttttactcttaacttccaaatatagcaaagacttcaacatcggtaaagaacaccactttgccaaaacacacagaactgcgtcttccactccaggtcaactcagagacaggaaaagttcatcagctcccaaaaaatgtcactgtgttcattttttttaacttcaaagaaaacacttatcaaaaaagtcattcctggacaggcacagtggctcacgcctataatcccagcacttttgggaggcagaggcaggcgaatcacctgaggtcaggagttcgagaccagcctggccaatgtggtgaaaccccgtctctaacaaaaatacaaaaattagccaggtgtggtggtcagggcacctgtaatcccacctacttgggaaggtgaggcgagagaatcgcttgaatctgggaggaagagtttgcagggagctgagattacactgctgcactccagctaagagtgagaccttgtctcaaaaataaataaataaataaataaataaataaagttttgccaaaagtgtcaaggggagctggggtcctgaagacccagctacctggggaagccaaggtgggagggtcgcttgaacccaggagtggccagcctgggcaccagggttagaccccaactctaaaaaaaaaaaatttcttttagtaattttttaaagaacaaaggggatgcagaaggtaacaaaattaaaatggctgcaggagctgagaaaacagccttcctgcaaaccactaatcagacccactcagtaggcctcagctttcccattcataagcaaacagctgggactaaatcaagggaaggtgatgtaaggacaaccgaaggtagaacaagagatcattcaggcaaaaccagacacctacttatatcactaacgaaaaaattacccgctttcaattctctaataatcctacagattgcttcagcaagaagtctcagtttggtgctgttatgcctttaacactttcatgacaacctcccccatgtttttttttgttttttttgttttttttttttttgagacagaggagtttcgctctgtcccccaggctggagtgaagtggcgcaatctcagctcactgcaacgtccatcccctgggttcaagcaattctcctgcttcagcctcctgagtagctgggattataggtgcctgctaccacaccgggccaatttttgtatttttagtagagacggggttctgccatgttggccaggctagtctcgaactcctgacctcaggcaatccacccgcctgggcctcccgaagtgctaggattccaggtgtgagacaccgcaccaggctttttttttttttttttttttgagacagggtcctgctctgtccacccaggctggagtgcaatggtgcaatcacagctcactgcagcttcaaacttctgggctcaagtaatcctcccatctcagcctcccgaatagctgagactaccggcatgtgccaccaggcccagctaatttttttttatttgtaaagacaagatctcagtgtgttgctcaggctggtcttaaactcctggcctcaagggatcctcccacttgagcctcccaaagtgctgcggttacagccactggctcaaacagccacactgaatcctaagaggagttgcttataaaagtcatgtggcaacagtttgtggaccatgaacatttgtggtcagcaggcttgtttgaaatgcacaaagcagttcaaagccaggttaagtgcacactctctagggcctggctgctatcattcaaagtccagctttgccattcactagcttgtgaccctagacacactgtgtaacctcaccgggcttcagttttctcatctataaaattggggtgataacagtacctacacttcatcaatttgtcaagaagactgagtaagtaacatacaaaaagtgcttaggacagcatctagcctagagtaaatgctatgcagacatattgctaccttatgtggtaggcaaactctaagtgggctcccgatgatcccaacctactaatattttgtgcccatctgtaatcccctccctctgacctagcaacttgcttctacccaatggaatacagcaaacgtaatgaggtgtcacttctgtgactggcctaagtaagcctgtcacttccatcttgccagcaggctctctccattgctggcttttgagacagtttcgctttgtagcccaggctggagtgcagtggcaagatctcggctcactgcaacctccacctcccaggttcaagcaagtctcgtgtaccagcctcctaagtagctgggactacaggcgcatgccatcatgccaggctgattttttgtattttggtagagatggggtttcacgatgttgcccaggctggtcctgaactcctgagctcatgcaatccacccacctcagcctcccaaagtgctgggattacaggtgtgagccaccatgcccagcctccattgctgattttgatgaagcaagctgccatgctggggaggcccacatggcagggaactgagggtggcccaggccacttgccctcaagaagtgaatcttgcctgccaccacctaaatgaccttgagagtggatcctttcccagttgagcctttgtgtgagtcccaaacccttgcagacaccatgactgcaactgcaagagatcctgaagcggagagccccgtggagccatgcccagattcctgacccacacacactgtaggataataaaggtgtgtgctgtttaaagctgctaagttttgtggtaatttgttctgcagcaatagataacaattacacctacacagaagaaataaaaagaaacatgaccaatgaaaactcatttgtgtaaaaaaaaaaattcatatatatttctctcaccactcagaattttaaaagattcctcttcccttaactcaatataataaagctaactctttattattaagactataagaattttagaaacaggctgggtgtggtggctcacacctgtaatcccaacactttgggaggactaggcaggaagatcacttgaggccaggagtttgagaccagcctgggcaacaaaatgagaccctgtttgcattttttaaaaagaaagaattctagaaacaaccatcctcaattattttcatccattctaaaaactagaactgtttactcatcagtattagtaatctactcatcagtaaagaataaattattaactacttagtaatttactaactaatctcagtagattataaatcaatagctattattaagttattgataataattgaagccaataaaaacaaagcccaactatgggtcaagcacttactacatgccaggcattgttctaggccttggcagtgagcaaaacagacaaaaattcctgcctttgtggacctgacattctggtggttattattaccaccgtggtctaatgacaagatacacagcacatcagtccagcgcactctcacatgacgctgagaactgcagatggtatctacctgaattcaacagtgaccataaaagcacttggcaggccgggcctggtggctcacacctgtaatcccagcactttgagaggccgaggtgggtggatcacccgaggtcaggagtttgagaccagcctggtcgacatggcgaaaccccatctctactaaaaaaatacaaagattagccaggcatggtggcgcgtgcctgtagtcccagctacttgggaggctgaggcaggagaattgcttgaacccaggaggcggaggttgcagtgagacgagattgtgtcactgcactccagcctggggaacagagtgagactccatctcaaaaaaaaaaaaaagcacttggcaacttaagagaaaaaaagaaggggcctgtgctgagacagttcccatgagttcaccaacaacaggcaatcctgcccaccatgccacttaatggggactgtgccccagagggcaggagacaggggagagggagtccccttggtccccctccccatccatcttgattcctggaaaaatcaaagtgtgggcatctcaccttgccagtctcatgtttaagtctctgtcacttctgctccacatgcaaagctctaaatgcaaaccaaacccctggtcagctgttcactgaaggatcagtcatgtgttccagtgccttaatgagtgacttgaattctcgaaggtaattctgattatgtcatttgcactttatgaactgactttagaatctaagcccacttggagtaagattcagtccattctacatttctctgttagacccaaattaaagaacgtggtcttggagattctgtttttaaaaaaaagggtcttcactccctaaagactgcaaggttaagacgctcacgcttcccctcgggagaccaagattctggcatcctgccaggtgtctgccatctccacggtagctctcccatccactcactttgctagtgtacttggcaatatcagcggcgacatcagctgaggcagtggcgatgggcaggtcagcgttgactgaggacacaagggtgctcatggaccccgagctggtgaccaggggcgatgactgtgtgctggtcaccagggtgatggtggacgtggatgggctctgtgtgatctccttctgctggacagctaggaaggcaaagcatcctgattaccccacgtgggaaggacccatcccagcacaaagctgtggtgtagaagcaaagcccctaatagacatcctgagagcttttctacttttaaatgacaaagatgctccccttgaccaaactctatccaggtttctcaactaggccctaaccttggcctggaaagacttgagcaaacattgacagtttctaagagctcaagagtgcatgctaggatgaccccaaccccctcttaaagcgactgcctgggaaaactcaatgctggcaaaagaactgacagttttgttccagccaacacctgaagacaggacctcagcatcccagtgtctatgggagagtaggggcccaacttcatgaagtgcccgttagcaaatcaagatgtttaacttccctgactctactgaggcccaactcgctcccatccctactccctcattctccctttaaaatgtccagtcacccctgtacaaatcaaagttaatttcagcttatgctagactcttgcccctattacagtagcatattaccaatttaaattggtctttacccctttaactaggctttactttggcgtaagacaatctgaagcaatgagccactttttggcagcgctcttttttttttttttgacagtctcactctgtcgcccaggctggagtgcagtggtgcaatcttagctcactgcaacctctacctctgaggttcaagggattctcatgcctccctcctgagtagccagggttacgggcatgtgccatcatgcccggctagttttttgctttttttttttttttccattttagtagagatggggtttcaccatgttgactgggctggtcttgaactcctggcctcaagtgatctgcctgccttggcctcccaaagtgctgggattacaggtgtgagccaccacgcccgaccctcttcttggtagcaattaaactcccctggggaagtctcctgcttatgagatatgaagacagaagacaggaagccgcaatcccaatctcaaatatcctagactcggctttgccccaccaactttttaaatagcaagattaatccaactgtactctcaattttgcctggccaattcttcaggacccactccctcgccatctgtgaagggtttcactgggggccaattcaagacctggccacctttcaacctcacattctgctgctcatgagcccccctcacaggggcgcattcactatgagtttcagttgaagaacccagcctttgaggatctagatgcaggtttcctggtagaaagatctacatcaatgctcacaaaagccaggcaaactggtaccaaccagtcagatcagcactgtgtttggcctaatttcagctccagatggagcctcctgcaggactggtgggagttctgattctgcaacttcagcaagtggttcttgaggctggctcatcttgtgtgtgtgacgaatctccagttactaaggtaaccttcgctatcaacttctcgcactgtactttttccaaaataactccaagaggttccctcatgtgcacaaggaaatttatacaaagatattcattgcagcactgctcacagtagaaaaaaaactgaaagcaacctaaatgcccattagtagaggaatgctttaaataaactatgaaatactatgcagcagtccaaaagaacaaggcagggctgtatgtgctgatgtggatggacctccaaaacatgctgatgggtgggggaaaaaagcaagtatggtaccatttttatgttttaaaaaagaaaaaaaggggggaaaaaggactaattttatggcatcatatacatgatgcgcacatatatacatacagatatgtatatatacatatacatgcatacatgcatagaaaagcttttacaacggttgatactggccactgtggaagggaagagaatgaaatggaaggtaaacgggataacagacttttatgtaaaactttctgccccctttttaaggagaatatatgcatgtatcatttataaaatgaacaaaaaaaactttttgaaagtaaaaaagcaagtagcaaaacaatttttaaaaataatgccaaatggaatgtgcaaggccttcaagatacaatggcccggaaacaaacgagaactaaaaaaaaaaaataaaagagcaatgactttctcctgtcgatgtggcaaaatgggagcgggcgccacggagaacagaaggggaggctcggtacctttcacagcctgtctggtctgatatctcgtcccctgggaagactgaggctgctgctgctggttttgctgctgctgctgctgctgctgacgctgcatcttctgcatgtgccacttttgggaggacgtttgaaacttacttgatgagttccacacgacccgctgcacggccggggcagtctccttcggtaaaagcggcctctgctttttcactgggcttcctgtggcggcgggggccggggccgtgacggtgaccgtggaggacgtgctggtggtggctgtggcgccagccgcggaagtttgggcggaagagcgggtgagcaccggtgtttccgggggagaatggctgcccaccgtcgtggatggtggagttttacctacaactagccaatgcatgaagaaaaaacaaacaaaaaccggatttcactcaggttcacctgcacggtcttgacgccaccaagttctgggtaaaacctatgaaagccaggaatgccgaaccaattcgacgtgccaagcacaccgcgctggaggagtacattctcacctaacgctgaggccacttctgcggcgtcttccatctccgcgagcagcggcctcctttactgagcgccggcccacatctgagatacaagtcaagacctctaggggagaatgaggcaaacaagacccggctcctgcgctcaagctcccctacacctagtggacaatgcggtgggcgaacagattcaatgttcacgcccttttcgcaaagttaaaatctagtcggcaccttgagaagggcccagcggaagtcaatccagacaggaagagcaattctttggctagggaacgtagaaagcaatacctccaaagagccagatggcctcccaatggccaaagcagtaacactcagtcacccagaaagaaaagtattcttttcatctcttctgattccctccaggacaaagtttgaaggcggtactgatagccaggacaataccaggaaaacaaattctgccccaaggccagaaccttcccccaacgcaatggtactgatctaggattgagtagcattgctttggttttgattggatttattcctatcaccagcttttatgtatactgtgtgctactgttcttattgggtggtgttcaagtctaaaatgagtttatacttgcagatgcttttttcaggggaaatttttttactaaaaaaatgaggccaagcacggtggctcacgcctgtaatcccagcacttcgggaggctgaggcaggcggatcacttgaggtcaggattttgagaccagcctgaccaacatggggaaaccccgtctctattaaaaatacaaaaaaattagccagacgtggtgggaaactgaggcaggagaattccttgaacccaggaggcggaagttgcagtgagccgagatcgcgccactgcactccggtctgtgagaaagagtgagtgagactccgtctcaaaaaatattactaataggccgggcgcagtggctcacgcctgtaatcccaacactttaggaggctgaggtgggcggatcacttgtggtcaggagttcaagagcagcctggccaacatagtgaaaccccgtctctaccgaaaatacaaaaatagccgggtgcggtggcaggcgcctgtagtcccagctactcaagaggctgaggcagaagaatcgcttgaacccgggacgtggaggttgcagggagccgagaccatgccattgcactccagcctgggtgacagggtgagactccgtctcaaaataataataataataaatgaaaagtaaataaaatgagtttattttatttatttattgagatggattctcactctgtcacccagggtggagtgcagtggcacaaacttggctcactgcaacctccgccctctgagttcaagcgattctcctgcctcagcctcccgactacgtgggattacaggcgcctgccaccgcacccagctaattttttttattttcagcagagacggggtttcgccatcttgcccaggctggtcttgaactcctgacctcatgatccatccgccttggcctcctaaagtgctggaattacaggcgtgagccaacgtgcccggcctattttattttatgttttaaagagatagagttttgctatatcaccccggctgggctcaagcaagccacttcagcctcccgaatagctgggactacacgggacgtgctactgtgtcccgctttaaatgagcttaattttatttttaaagaatgagattcttggccgggtgcagtggctcacgcctgtaatcccagcactttgggaggccgaggcgggcagatcacgaagtcaggagttcgaaaccagtctggccaacatggtgaaaccccatctctactaaagatacaaaaaattagccgggcatggtggtgtgtgcctataatcccagctacttgggaggctgaggcaggagaatcgcttgaacccatgaggcagaggttgcagtgagccgaaatcgccccattgcactccagcctgggtgacagggcgagactccgtctcaaaaaaaaaaaaaaaaaaaagattctttaaataaaaaaagtcaaaaattatacaagcaggacttgagaacgggaaagacaatgaatgtgaatgactcaagtttgaaaaacgctgccatatggagtatgtcatcttggaggagctgggctggtggggaataaagggtaggatttcaacaggcggaaagtgagaatctggagggaacagcatcagccaagatatgtctaggaatacagagcatttgagtaagtgagggcaggcagggaggaggggctggaagggaggttagagccagaagcactgagcagcacgtagaggcgatgaccacacgggagctcatttgtaaaggtggctcagttatggatgcacaggcctcagcccccggtaaggtgagcctatgccccagagaggatatctggggaacacacaccacacccaggtacaagccagcaccccgatcttggactatgctccctgacatcaaactcctttaaataaggattatgtctgcctctttttcttttcttttttttttttttttgagatggagtcttgctctgtcacccaggctggagtgcagtggcgcgatctcggctcactgcaagctccgcctcctgggttcacaccattctcctgccttagcctcccgagtagctgggactacaggtgcccgccaccatgcccagctcattttttgtattctcagtagaggcggggtttcactgtgttagccaggatggtctcaatctcctgaccttgtgatccacccgcctcggcctcccaaagtgctgggattacaggcgtgagccgctgcgcccggcctatgtctgtctttttaagatcagtattacccagaaaaagacatgagcctgattactccagcaaggattttcattcagtaagctgtgggttttaagaagccaaggagggaaagagacaagctgactatcccgacttcagagggcgttctcgatggttatcgagatgttgctggcccttgtacttccccagagaggagaatccagccaagctggtcagcaagagcctggggtgggtctggaaggagagcttcctgcagtgaagaactccgatgcttccagggccacctgccagatatggggcacagtccccgcctcttccaggtggagatgaggtgttgaactgggcccttctaagaggagggcagggggcagtgccttagcagagcttctaacccacgtaagtgccttcaatgccttcctttcctgccacattaccaaaaaatatactgttattgttgatgagctagcctgtctccccaccgtaagggcaaccgcaaaatggtcgttttctctctcctgatttgcaaaagcaaacagccagcagggcggaggggttactgctctgcagtgatcacagctggctctctgccaaataaagaactagagtatacaatccgataagattccaggctcaaaattgtttgaagttatttagatatcaaaatatttaaatttccaggaatcctgatggtttatggagacaaaatgaggctacaggaaatttcatttgtcccagaaatctggagtacataatcaatcacctgtagcgggaaaaaaagggtgaatttttttttaaagggtcagcacctgagaagctgccctatcaaattaacctacttaattcctgaatttgtcactggtcactgtttttcatttataaagcaaggactttttaagagaaaaattagcatcccctttgtagaaggatggaaattactgatgtgccagtgaaagcacagcgaagagtctaagtgtgctctctttgcttctgttctgaggttattagctataaaagctgttttgccatctgaagattcatattctacccataagctgcatccctagtggaaggtaagctggaggtcacaacagcgcaatccaaaatgcccttcacttactaaactcttaagtgaaaacacatcattgaaaagatgctctctagcggagtctgacacgagaatttttcaagacccaaaccaccatcagctctgaatttaagatcaattggttttgccccaagccttaggaagctgctctaactgaactgtgttttagaatcatcttcagcttaattgtccaccatctactaaagcttcctggagaaattcccttcagacatcaatgtgaggaaaagttctacttcttttaatcaactagaatggttttttgtttttttggaaagtatgagatcttctaaggtactgtgtttcccattctgctttcagagccaacttccctaactctgaagattgaaatagtacagatttctgtataaaacctttccccagaccacttgctattctaccttcattttccttttacatggatgtctttattttcatcttgtttcatatggttatgtatccttgtcaatctgttgcaaattctttctggaagaggtaggggcacaaaaccaatcaatcaaaagatctgttccagaaagaaagaacagtataaatatgtcactcataggagcactgccatctgcacccaaatattcctacgatcctcatgaaataaatgctactcctattgttctctgcaacaacagagacagtctctcaaaacccaatccataacatactcatatttttcagaggccatctataaatctaacagatgggtcgggatggtttgatggcctatcctccctcccttatgtaactgtatctctctcttcctccactgtacctctcacagacattctctttagctgaactgcaggaatcctctctcactctgacagctgaggttccagagcagcccaggttgaccataaccacagcagaaagattctcaaggcccatccctgacttgctttaagccaccagacaatggaaaccccaaaggacatggagttacatcttattcaagggtttcattgacaagttagctcctgatagaagttaggcacagtcaagatttaaacctggctatcccttaagtcactcgccacatacataaggttttatggctacaacctgtaatttgtcctggggcaatgtttcttctgggcccttagttaattcttcagtatctttattgagcatgttgaatcctctaacctaattgccaagccaactcaaaaatgtgctgaatactttgtcagtgggaaggacatccttccaatcattcccacaccccttttgttgggcttgttaacatgcccaggctgcactaggctgtggggtagtcactgctggttcagaatataaccgtagcctctgagactcaggggatatttggcaatatttgattgccacatttgtgactgccacaactgagcaagtaaggttgccatctggctggtagaggccagggatgctggaaaacatcctccaatacacaggactaagaattagccagggcaaactgtcagaagtgcaaggttgtgaaactctgagctaagttaaatgcaaataagattaaaagccagtaaggccagacgcagtagctcatgcctgtaatcccagcactttaggaggccgagctgggtggctcacctgaggtcaggagtttgagaccagcctggccaacatggtgaaaccctgtttctactaaaaatacaaaaattagccaggcgtggtggcaggtgcctgtaatcccagttacttgggaggctgagggaggagaatcacttgaacccgggaggcggaggttgcagtcagccgagattgtaccattgtactccagcctgggcgacaagagccaaattctgtccgccccccctccccaaaaaagccaatacacatatccaccatactccattttctagtgccctaagaagcactcagtattctggcaccaatcacccaaatactgtcctactactgtaagaaaatacacttggagatgcctaggtggcatgaggggaggaaagcaaagctgaaatcatcaaaacctttgaaatgaacactgctttttttttagagagggagtcttgctctgccacccacactggagtgcagtggcgcaatctcagctcactgcaacctccgcctcctgggttcaagcgattatcctgcctccgcctcacgagtagctgggattacaggcgcctgctaccacgccccgctaatttttgtattttagtagagacagggtttcactatgtaggtcaagctggttttgaactcctgacctcaaatgatccacccgcctcggcctccccaagtgctgggattacaggcgtgagccaccatgcccagcttgaaatgaacactcctaaccgtttgagacttgtcaaaagagaatgagatgtctgtggaatgcagcactgaaggaccatttgacaagatccaaatgttaacaaacactttggggaaataaatgagcatattggaaaagaagctgctcagactaaaaatgacttggtcactaaaagtaaccatcattttctaacagacttctctttctgtactcaaaatcaatcatactggataccgagcaggttaaaggtaggcaggcccatgtttgagtccaggtcctgttctatgactagctaggcaaccttaaaccaaacacagcttcactgtgcctctctctcagtgtgttagagggtcacataacttctgatttgtttctttaagggtcacataacttttgatagtaagtgtacgaggtaggattctaaaccaaattaagaaaactggaaacagatacaatcacttaccatcctgtttgggagatggttctttgggttccttcttattttttcgaccctcccgcccagaatggtcttctcctaaatctatgacaagttcgctctctgaatcagagtccaggcccaaatggactgttggggaatccgtctcatcttttcccttcagtttatcctttatggggtgaggtgaaggttttgccttttcggaaaagtccttctcaggctcagggctggccttgtccttgactgctccagggtctgccttctcgctggctggtgacgtgcttttcagctcctctttaatctccactgggtttgtaggcttgggcttttttttaacagcagatggctctttgtccatctgacaaccttctttgtcctctgtgtcttctggctcgttcttagacttctgctcatcatcactgatatactcactatcgctactatctgacttctcagaatcctccgaatcgctgtgctctacggccgtatagacatcttccgagatttcatttatgcctaaattcaaaaagaaaacccagcatgtggcgtagtcacaaaataaagagcaggatgaaaaatgcaaacatttttccacaccaaatgctggaataagaaaagcacgtttcaaatcgcatcacattggcctaaatggggccagtaataatctcaagtggcaactggctacggctgccaagtggtacttgccttgggagagggttttggttgttaggagacacaggacctaccaacggagattttaaatttatatggcactaaacatgtggtgccaaatttttgcaacgttgataactaattgggattattgagaatgaagagggctggaagggaacagcagggacaagctgttcaaactgatccaatttacagattagaaaacagaggcccagggatatcacctgccctaggacacaagacagaggccaggccagaaccccgggttcctggctccccaccaacactcttcccttgggtttccaaagggttaaagttcttgatcctttgtgtctaggccaaagaaaataagccaaagccttaaagcagaggttgcaaacagcccacaagccacatctagcttgcagacatgtttcatgcgagaggcactggtttggcccacagggtatcttgtctgcttttaatttataaatgtgttgtccaactcacaaatcaggaaatttcatatagaaatcaaagcaggggcttctgatgaaagagcggaaaatctagccgctctgggtcaccagcctgccaggcattggctggaacaggaaagccactggctcctctaggcgggggacacacttgtctccaggtgacccgggtgcccagccctccctcttgttccctgcactcgtggaaagtcaactgccactcggtgtgcattgctcttccactggtaaaggagtcaagagagaagtcacatacttctgtctctttcaaaaggaagaagcacaaactagcaggtgtttcatacacacaaacaaaaatgggcagaagcacatttctaacaatagttccatttaacccatttacggctcctgcccccaaccatatgttatgccatcatactgtagataataataccatatcctaaacttttagaaagaggaaagaaaacccaatcaagtctgtgcaatctcttcattctagagcaatggccactgtgaatggtgccactgtccgacttgtatacaccaaaaagaaacctgcaaaaataccagagccatgaacagcccggggcatgggggatcagctggatcattggggaatgtatctgcctccaccagggctcaatcaaaaacacaagtcgagccaggcatggtggtgcacacctgtggtcccagctactcaggaggctgaggcagaagaactgcttgaacccaggagttcaaggctagccagggcaacacaggaagaacacaagccaaaatacaaacacccagatctggtataattctgggatcctaggcttgtgctactggtaggtaatgattggaaacaagaaggaaaagtgtaagcacatatgtgataggaaaagcttgggtactgcagtccaaaggacatgaattcaaatcctgcttttctgtttttattactggtgtgaccctgaacaagttatttatctctctgagcctcagtttctctatccgcaaaatgggactgataaaagtatcaacctcccaagacaatctatatgcagtgcttagcatagtgtccaaggaaacactcagtaaatggaaataataaaattcttattagcaataaaaacaaatcaagagttgggccagctgcatggaaggacccaagaggattatttaaatggcatgccaaatttcacccatgccacccaatgtcctcaccaaacaggcaacccaacgggagctgttgtcctctggatagccccagatgggtccctaactctagctgctttctcacctgaagatgcagagcacccactgacactcagaggagcttgctctccagaggcccagccatcccccacttctttacaaatgccctcctagctttacttacttattcaacaaacattccagagcatctaccatgtgcacagaccaagtaccatagagaaggcaaatcctcataaaacggcctccctgccctcaaggagcttccagtctagattgggagggacacccccacacaaagggaccattgctacttccgagcaatgaagtaccaaaggaggagggcagatggggagggcagtcaggggagacttcctggaggaggtgagatctgagctcagcctcacagaaggcaggattcaggtaggcagtgtgaaggcaggcagcacagggaagaggaagaaaggcaacagctacagaagcagggtttgcccggtggggaggagaccagtctggagggaaagggtttcgtgtcggacacctacagaacacactcactactcgtgtggagacactgatgcgtactgaggagagcagaggcaaaactcagaggatcctcattctgcttgcaaaccttgatgattcaaacctgtatctcgagtttccagactgctttcaccaaagaataaactgatgagttcaaaaagccctgaattaactagcaagtctgaagtcttttgccatgagtggaaatatattttagctgagcaaatagttgaaagttaaagcagctgctaaaagcagccaggattcaaccttgatttcatccaggtggtatccctaccagtaatgataacaatgatactgctggaaaaaaaaaacaaaaccaaaggtatacctaattgtgctttgcaactctctatggtcttgtcaagattcagctggaacctgctacgaatctggcgcttgggagagatgagaggaacaggggtggactgttgctggaccgactcgctcagctccttcaaatccatctcagctttgcttcgatctgaaagaaaccatcacaccctcgtaagatcaggcacacaccatcctcatcacggagcttcgtccttgcaaagtcagagcaaaacacacattttagaacatgggggagggggagatactttttttgtcattcatcccaacaatatcatctgctcaaccaaatggggtgacatgaagataatggcccacgtgaacacgtttggcaggtttaaacagtccactgaacaatcgtctgggtgactttcaatatttaaaatggacaatcccagccagatggctcagtgtgtggaagtcaacatcattagggaccctccaaagacaaaggttatgggcagatattcaatctcaatttcagtgaacaaagcaacactgagcctggtcaaggtgtacttgtaacttcaggtccagattgaagaggacttgtatccaagaaagatggcgaccccctcgaaaacaccctgataattgggggccctaaatgcctatttgccacagaggcttcatttttcattctcagtggacctagtctggggtggaaactagaaagggcagggaatataagataggcagaccttccagccagtgtgttgtggctcacagcatctatgtgaggcaaggggaacagattagccctggatactcaacctctgtctaacaggtctcgctcaagtaagagtccaaggtcctcagcctagttcccaggcagaggcctctggggggtgactcaggccggaggtcctgtcccctcacttcttcgagggctctttgtaggaccagcaggacagattccaaagtcagtgagcttacatttcttggattcctctcccaccgactccagtgcccccaaaatattaagagtttcagtggctgcaaaggtccagaaagcaacaagcaactctgcaggtggggcctactgtcctccactgtgcctgccaccctctggcatcccctccaacccacccaaagcgagtgtgaggcatctgtcctactccggccgatcccaaaaaataagtcagaaagcaggtggaatccaatcaacccacaaagaggagaagccacctctgagcctgttcccaacagctatcaggttgctccctggacttcgtgcttcatctccctgctccctccatacctcaggccacctccattcattgggctgtgaaagaggccccagaatctagtctgagagctgggctggaagcactgtttaaagccatcactctctcctacctttttcctttggcctgacccaaccactttcctgttcatgcagtaagggagagttctcaaacactgcatacccagaaatcagctccttcaaagtaactagaagcagcctcccaaaagccccacccaatccactcacaggtgaccagaagcaataaattgctccaacttaattttatcagcccccaggataagattagaaagaggtcttttcccagccaggtgtggtggaatgcacctgtagtcccagctactcaggaggctgaggcaggagaatggcttgagccaggagttagtggctgtactgagctatgatcacgccactgcactctagactgggagacagagcaagactttttttttttgaaggaaaaaaaaggagggaagagatgggtcttttcctaaatcacacttacagactgcccctcccagacccagggagattccagaagtgagtgctcaaagcaagcagagacactatccctgtaattcaagaaaaatagcaaaaacagtatctgtgtgcatgcatgtgtgtgtgcacacttatcagggctttaaagacaggctactagagacaggactgcagacattcacacagccacctctgagagggtgaagaatgtgcaaatttactgcagtggggccaggcacagtgattcacacctctcccagcactttcggaggcagaggcaggaggattgcttgaggccaggagttcgagaccaggctgggcaacatagcaagacccccatctctacaaaaaatacaaaaagtagctgggcttggtggtgcacgcctgtaaacctagctacttgggaggccgaagtaggaggactgcttgagcccaggagtttgaggctgcagtgagccatgattgcgtcactgcactccagcctgggtgagcaagatcctgtctccaaaaaaaaaaaaaatttactggacaaagaactagaaaactctttatacccgtctctgtccggcaagaaatctgaagtagcttaacaaagagaaattatagggtaaaataattttaaaaataaggaatggggaacactaaaagaaaagggaggagcgcctctgcccagtcgccccaccatctgggaagcaaggagtgcatctctgcccggccgccgcaccgtctgggaagtgaggagcgcctctgccccgccccgcaccatctgggaagtgaggagcacctctgtctggccgccatgcaagcctccaggtgtaaagtggcagccttgtgtgtgatctttctgccctccccgagtttgcatttttgacactaaagtttacttttaaattaaaagtttatttaaaaaaaaaaagaaagaaagaaaagagaaatgccgggcgcagcagttcacgcctgtaatccagcactgtggaaggccaaggcgggaggatcacttgaggtcgggggttcaagatccgcctggctaacatggtgaaatcccgtctctactaaaaataaaaaaattagccaggcatggtggtgggtgcctgtaatccccggtactcaggaggctgaggcaggagaacacttgaacccaggaggcgaaggttgcagtgagcgagatcgcaccactacactccagcctgggcgacagagcaagactctgtctcaaaaaaaaaaaaaaaaaaaaaaagcccagattaaagagttccagtaggcaggactcaaggacttaacagctgagttgcatgcaaatgtgacagcaaagggggagggatttgaggcctccctcggaatttccactttcagaaatgaagaagcatgctagattccagagggaaaagccagccttttcaagaataaagatggaaacgtatactcacaaaaatactctccatggctacccaagtgacacattcatcagtgtcctcaatattcctatatactactagaatacacagttaacgaaaaaatttacaaaagagaccaacaaactttctttgtaaaagcctggagaggaccgggaacagtggctcacacttgtaatccctgcaattgggaggctgaggtgggcagttcccttgagctcacatttgagaccagcctgggcaacatggtgaaaccctgtctctactaaaaatatgaaaattagccaggcatggtggcacacgcctgtaatcccagctactcaggaggctaaggtgggaggatcgcttgagcccaggaggcagaggttgcagtgagccgagatcaggccactgcactccagactgggcaaaagagccagaccttatctcaaaaaataaaataaaagcccagagagtaaatatttcaggctttgcaggccatacaggctctgttgcaaaagcagccatgaacactacataaacagatgggtgtggatgtgttccagtaaactttatttgcaaacacaggtgggggccagatttggcctgaaagccgtaaaatctgccatcttctatactagtccagtgactgccaaccctggctgcacaccaaaattgcctgtaaagttttagaaaatcctgaggcctgagccccatcctcagagactctgactcaattggctgaggggaaggcctgggcatcagccttttacaaacttgccaggaggtcgagcgcagtggctcatgcctgtaaccccagcactttaggaggccaaagcaggtggagcacctgaggtcaggagttcaagaccaacctgaccaacatggtgaaatgccatctctactaaatatacaaaaattagccaggcatgatggcacctgcctgtaatcccagctgcttcggaagctgaggcaagagaatcacttgaacccaggaggaggagcctgcagtgagccgagatcacaccactgcactccagcctgggcaacagaatgagactccatctcaaaaaaaaaaaaaaaaaaccacaccaacaataaacttgccaggtgatcctaattggcagctaaggctgagaacccctgtatcagaccaatcttctatgtgagtaaagaaaactcactatttgccttaactcctgtgtgtgtgttaacaggacaacctttctaaaccttagggtccataaaaagagacctagacctcacctgaataactgagctctgtgtgtgcacctgcgtgtctacacgtatggctacagtaaatgcgacccattaactttagcctaaaaagactgagcactggaatgttcataatcaagaaaaatgcaaagaaggtaaattccctcattttacaaactgaggtttctctggtcagtaagctgctgttatgtttattcttgttagaataaaccaccaaatggctaggggctgggcccaggccctggaagctgaccttcaggagtttagccgaatgtaatgatctttatccaaacctgcagctgcatttgactcccccctcctccgcagagagaaaacagcttcactttctcatttagctcatgtagcttatcgggacttcttccacccctgcccttctatatcgggaatatcttcagaatccacccttgctgccaacattttgaacttttcagctgatatgaagacagcttaggctataaatggaaaccagggatgaaaaatactcacgctagagaaaaaggcacgatcttacatttctggagggagcataaatcagaaccacctctttagagggcagttgggcgatacctctcaaaatgtcgccgcatgtggcctctgatgctcaattccacttctaggaatttatcctatggattaccctcccacgtgggcaaaagggttcttcattgcagttgtcttcaatagcaaaaatggaaagaagcgtagcgtcagtaagtaaggcgcctgaataaatgttacagtttacctttaaatggaattaaatacagctgctaaaatgaaatgaaggccgatttctgtgtgttgatatgaaaagccaacctgtttcatgaaaaagcaaagactggtggagcaccttagcactgctgtaggggagccaagaaggaaatggaaaatcgctgggaaggctatatattctcagggtttctcaacagtggcactattgatatttgggtcctggataagtctttgtggtgggggtggggtggggtggaggggctgtcccgtgtgttgtaggatgttcagcagcaccctggcctctaccccctagatgctattagcacctacacaccagttgtgacaataaaaatatctccaggccaggcgcagtgcctcatgcctgcaatcccagcattttgggaggctgaggtgggcagatcactcgaggtcaggagtttgagacaagcctggccaacacggtgaaaccccgtctctactaaaaccccatctctactaaaaatacaaaaattagccggacgtagtggcgcgcgcctgtaatcccagctactcaggaggcggagtcaggcaaaggttgcggagagccagatcatgccactgcacaccagcctgggcaaacagagcgacgctccatctcaaaaaaataaataaaacataaaaatatctccagacactgccaaatgtcacctgggagacaaaaaccattcagaactcatgctatatatctagaagggctctagaaactaaaaacttgcaacagtggtgacgtgcaggaacaggggtatagagacaggtggttggaggttacagacacgctggcctttcatgaaatgtcctgtgctttgaaatttttgttaccatatgtactcattacttataaaaacaaactctataaaagaaaaatttaagaacttctttttccatttaaaaaaagagagacagggccgggcgtggtagctcacacctgtaatcccaccactttgggaagccgaggtggagatataaatatatatatccaccatatacatatacatatgcatatggtggatatatatacacaccatatacatatactcagtgtgtgtgtgtgtgtgtgtgtgtgtgtgtgtgtatatatatatatatacacaccatatacatatactcagtatatatataccatatacatatactcagtatatgtatatggtgtatgtgtgtgtgtgtatatatatatatatatataccgtgtatgtgtgtatatatatatatatatatatatatatatatatatatatatacggtatatatatatatttgtatgtgtatatatatataccgtatatatatatatttgtatgtatatatatatacacacacacacaccatatactgaggtcaggagttcgagaccagcctggccaacatggtgaaaccctatctctactaaatacaaaaaattagccgggcatggtggcgtatgcctgttatctcagctgcttgggaggctgaggcaggagaatcacccgaacccaggaggtggaggttgcagagagccgagattgtaccattgcactccagcctgggcaacaagagcaaagctctgtctcaaaaaaaaaaaagacagatttttgttctaaagctgaacgcaaactacaatggatggacttccaggaactacaaaatgtcagttccttcaagggagcaatatcacttagacaaaagaccctagctggccaggcatggtggctcatgcctgtaatcccagcactttgggaggctgaggcaggaggactgcttgaggccagaagtttgagaccagcctgggaaacatagcgagaccctgtctctatattattttttaaaaaaagagaggccgggcacagtggctcacgcctgtaatcccagcactttgggaggccgaggcgagtggatcacgaggtcaggagattgagaccatcctggctaacacagtgaaaccctgtctctactaaaaaatacaaaaaattagccaggcatggtggcgggcacctgtagtcccagctacttgggaggctgaggcaggagaatggtgtgaacccaggaggcggagcttacagtgagccgagatcgcgccactgcactccagcgtgggcgacagagcaagactccatctcaaaaaagagagagaccctggcagacactatctttcagtcaaagccaaacagagatcttccccacctcattcactctaaagaaaatcaagacaacatctgaaaaatctgggcccaggcactccatgtatgctctcaaagaaagcccgacttccaagataccgctttatgcacaaaaagaaaggatgcctcctgtcattaacagtggagaaataaacagaaagtctcggggtgtgacgacgttccctggccctgcctgcattttcaacagagcatcaaggcgcatttctgtcactaacaggactactgactgctgagtttcttcagctcaaagtaaacaccctctgtgaaataagaggagatgggatcatcagagaaagcaaacaggagtctggaagaagaaaaggaccgggcccacctcttctcttctagtctcagaaactcattcctatttatgacttatttataatcactgctgagtcatacagggggctcgtaataatccactgggctcagctccttgttttttagtgaggagaggaaaggccccagacagcaaatgaggggaaacagtgaattagcaacctgggcaagaaccaggtctctgtacaaaccttcccatcttataccatatagtcatataccatacacacacacaaataccatatactcatataccacatatacatatactcatatgccatatacacaaatacacatacactcaccatatacacacatacatacacacaaataccatatactcacataccatatacacatttaccatatactcatatgccatacacacacaaatatatacccatatactatatgctcaccatatacacacacgcaaatacaacacacacatacatacttatataccatacacacacatacatatactcacatatacccaatatacaaacatacccatataccatatactcatcatataccatacacacatacatatactcaaatatacccatataccatatactgtcataccatatacacacatacatatactcataccatatacccaatatacatacatataccatatacacacatacatatactaaaatgccatatacttatataccatatattcttaattatagtgtaacagtataatataattacagtatagtataaataaaaactgacaacctatggactatttttgtattgttggttgtatgtgtttgtctggcccaaatagagttttggggttttgtttttgtttttgtaccacagggtctcactctctcacccaggctggagtgcagtgatgcaatcatagctcactgcaaccttgaactcctgggctcaagcaatcctcctgcctcagcctcccaacgtgcgggaattacagacataagccaccaagcctagccagtttttgtttttaatgaaattgattgtcagcttttaaaaactaggagagttcctgtaataatctagagttctgtttttcctgacaattcagtccgacaatgtgggttaagctggcaagagccacatcctttacaaatttcaaaacttcaccttaccccctgacccccaaaaaagctgacgtatccaataggcacaggagacattcaggtatctcagctaagagctcaagctttgcagcagacaggcctgggcctgaaggccaaactctaccacaaaccatggttgatccttgggtaggtaacttgcttctctgtgccccagtttacacttctgtgaaacatagatattacctactttaaaggttgttgtaatttttaaaaagttttaatttacagacagcaaaattcacttttgggagaatacagtcctatgagtcgtaacacctgcatagattcctgtaaccaccaccacaaccaaaacacagagcaggtccatctcccgaagagttccctcccaatgtgtaggcaaaccctcctgcactccaacccccagctatcactcatctgttccccatctctgtaattctgccttttctgatatattttttaaggaaatcctgttttgttagctacaataacttcatcattatccagggtgctccctttcattgtccctgtctggggaaagtcgttccacggctgacagacagaatcaagccctataaagcatttgttcagtccctgggcagtcactggagaattccttaacattgccctgcttgttctgatctcctccccacccacggcacttccatcggtccctagctgatcctcttcccgttaggtcattgcaatcccagcccacaaaacgcccacattcccaatgctcttgttcctgctgacgaagataagaaatgtgtcctgaaccggaagagctgccaggggagacacaagagggcctcggttcccctggtgctcacccaccaccatgcccacccaccaagacacacaacaggaagaaacctttcactcccacaacagatcaagccaaactgaaagacccacagtgtcacgaggaagcccaatgaccacccagtttcagcaaagagctattcttgacaagcatgactggcagagaggaaatgtcaccgtgagaacgcctccaaacagcatttcttttcagggtgtggaggtggaaggagggtgtgagaaagcaaaccacagatttgggaacaatgaatgttcccaaggaagcacgtgtgtcccttttcactcaagtgaggaaccaactggttggtctgaatgggagccccgaaagcaactgccctgaccatcctattacatcagggctgtactcacaggtgagccaggattggagccaggctgtgctccagccctgctgcctctgggatcctgggcaccccatgcctcctctccagacctccctcagtttctccatctgaaaatggcactgtaggacaagatggacctggagggcgccaaccaccaaaggcgtggaattcacacttaagcgtcactgggcacaggtggccgccctctctttctgaaacccccatactggaggctccagggcaacacactcccctggtgtggctactccaccccttgcttctcctcctcaaccagaactccacatcctcaatgtcccaggggcctcactcctgctcaatgctctacccctgactcgcaacctcagtaagccaatggggctggagtctttgttgagtgaggctgtcctatgcactgggggatgtttagcgcaactctggccaccaatcattagatgccagcagtgtccccatcaccccctcaaagtcatttcaagaactaccactctaacccaatcccacgtacacgtcaagattcccagaattacacctcctgcctgaacctggccacagggaaccctaattcctgcctccagctgccctattgacctctccacctaggggtgtaacagctgctcaaatttacataatctaaactagacccttggcttctcctgccatacccagatctgtcagcacaattactgacacaatctagaaattctctgttgggggccctgttctacattttgtaggatgttgggtggtatctccctggcctccctccattaggtgccaggagcaccccaaccccaggtgtgacaaccaaaaatgtctccaaacattgccagtgggtggggaagtgttacaaaattgcccccagatgagaatggttgactgatatggactatttgaaacacagcaccgagggcttcttctgagatgtgaagtccattcacatccctcctgcgctgaaccctccatccacaccagggtctacgaggcccccgtactgtctccgactccacggactggcctcaccctcactcactgggatgcagccaccctggcctccttgctaatcctacaacacacccagttactcctatagcacaccaacttaatcctaaccctagagcctttaaaatctcttattccttctagaatctttttcctcctgacactggcatggctgatttttcttgtcacgtaaacttcagctcaaatatcgcctctcaaagaggccccgtttaacccctccacctaagtgaactgtgacatctgcttcgcaacttgcccatctcttgcctcatcacattaccttccagacatccatcatggtgtgaactatcttggtgtgaactgcctctcatggtgtgaactgccttgttatttgcctttattattttctctatctttctaaaaacccagcctctacaagagcaggtccttagctgacttgctttgtactctatttccatgcctagaatagtgcacagcacataatagatgttcaagaaaaatcaatggtgaggatgcaatgaatcaatcaataatgaatcaacagcagccgggcacagtggctcatgcctgtaatcccagcattttgggaggctgaggcaggcagatcaccttaggttgggagttcgagaccagcctgaccaacatggagaaacctcatctctactaaaaatacaaaattagccaggcgtggtggtgcatgcctgtaatcccagctactcggaggctcaggcaggagaatcacttgaacctgggaagcagaagtttgcagtgagccaagatcacgccattgcattgcagcctgggcaacaagagcgaaactccatctcaaaaaaaataataataataaggaatcaataatgggccaggtgcagtgacttatgcctgtaatctcagcactttgggaggctaaagtgggaggactgcttgaggccaagagttcaagaccagcctgggcaacacagcaagacccaatcactacaaaaaattagctgagtatgtagctaaaaactagctaggcctgtagtcctagctactcagggagggtgaggcaggaaatagcttgagcccaggagttcaaggttgcagtgaactatgattacaccactgcactccagcctgggtgacagagtgagaccccatctctaaaaaaacagttatcatcatcatcatcatcatcatcatcatcatcatcatcatcatccagggaataaagaccagagtgtaagaattagaagaagagaattaaggaatatcagagtatgctgcacataggaaaggtaagtactgattcctcctacttgcttctgtgccatgggtataatttgcaaatagaactgggttaatgtggtcaaggacaactgaggtggaaacactggcctggataaaagcactttgggccaggcatggtggtttatgcccgtcatcccattacttttggaggcagaggtgggtggatcacctgaggtcggggtttgagaccagcctggccaacatggtgaaactctgtctctactaaaaatagaaaacttagccaggtgtggtggcatactcctgtaatcttagctactcgggaggctgaggcaggagaatcacttcaacccaggaggcggaggttgcagggagccgagaccgcacccttgcactccagcctgggcaacaagagcgaaactccatctcaaaaaaaaaaaagtaatttgtatgtcaataagccccaagaaatcccttacttattcttttcacagatcttttctcaccttcatcctctgaaacttttgcattttttgcatagagaaaagagttgaaggttcaagaaccacatacacaagaggatacgtcatttgcaaaaatatccacagttgccacagaaagatactggcaaaaattctgactgacccaggttaagattcaggatgctgccggtggtggaggttttgtccgttttcgtcgtgataggagctgacagttgaggagagaagggctttgggctgccggataaactccctgcttgtcccgtcttggtggaggctggtgaagctgaaaaagtatggcattgttaaaagacaggtttacaaataaacaagtagaacgtgtaggtgtggtgtagggagagaatggagagattatgaaattgtgtttgatttcagcaaggccgctacagtatcacgaatggggtggggtggagcatagcaggttggccatttattttcagcaaagggctttaaccggatgtgaaaccgttaaagccacaaatgaagaaggtctccccagttactctattaagcacaaagctctaagacaaatcggctaagctgccactgaaattggtttggcccattcacggatataaatctcaacataaatagcgattaaaccaacccccacatggtccagatgtggagaacgggagccaggcttacaaatgcgtatcatctgtttgtggaaagacaccacggccagctcacacgcagccactgcacctgccagggaccaacttggccccttgggaaatctccagctcccatttcaaaggttcttgaggctatgtaaagccaaacccagtaccagatggagtgagggagacgttggtaaattatgtccttctttactgtatttcaaactttcacaggaggagagagaactgtacctatgcctaaggcttttaaaaataccttaaaatgacctacgacctgcttctcccctgcctcatttcacagggttaggacaataaaccacttacgtttaaaaaagcaagcattcataggggccaacaagcgtcctaaagatccttcaaatcctgcccctttgtccttgcccctccatggtactgggactgtcctgttaatgcctcttgggcccatttaaaaacagctgggactaaaggcatcactaacaacaatgacagccaactcttccaagatgagcaagaaacattctgagttgatctggtgctggaaagaaatttgtggatggcaaattggagttaggaactgagactccccaggggcttcgaaagtgctgggacacttgtgtgggcagcacttgcctcagtttcctcacctgacaaattagaaaactcagaacaaggcttcagtgtgttgaaactcacataccactcggctggtgaatccaagtaagctaggcagctctggtgccaggacctgcctgcattactgttaatgtaatatagtgggaaagactccagaagtaaagaggcctggattcaagcacagattagaagccagacactgtggattcaagccccggctcagctgttgccctgctgtgtaaccctgggccagttactggcacctctgcctccctcttcctggcagcagcaaagagagacactaataatatgatacaaagggacaataacagtagctacatctcatcaggctgccgtgaggattaaatcaatcatctgaacagtgcctggcatgcagtaagtactctgttactgtttgctattagagtggttttattttctatttccccattaacctctagggctttggggttatcctctgaaccactgattctcagctatgagcaattcttctctccagggcacactgggcattgcatccagacattttaggagagtggggggttgctactggcatctaggagctagagaccaaaacgctgctaaatctgctgccatgcacagagcggccccccacaagaaagagttatctggccccaaacgtcaaaagtgctgaaactgacacgccgcatagggatggagtaggcatgcagctgggaatccttttcctcatccgggaatgataagggagtgaggatcaatgtcgtcgatctatgtcaattggcgccgagcaagtgctcaataaatattagaaattgttttaagaaataagttttctttgcttttgtttttttgagatggagtctcgctctgtcacccaggctggagtgcagttgtgcaatctcggctcactgcaacctctgcctcctggattcaagcgattctcctgcctcagcctcccaaatagctagaacttcaggctcctgctatcacacccggctattttttatatttttactagagacagggttttaccatgttggccaggctggtctggaactcctggcctcaagggatccacccgcctcagcctcccgaagtgctgggattacagccatgagtcactgtgcccagcctataattaagtttttaacacaataaatctgttttactgcaagaattaatagaattggcctagcacgtggcatgccacattccttcactggggggggctgctatattattactagtcctatcactggtactgtaagacatagaactgaagtgtttgttacacgaagaaacaagaatatgccaggtgcggtggttcacccctgtaatcccagcaccttgggaggctgaggtgggaggatcacttgagctcggaagttcgagaccagcctgggtaacatggcgaagcctcatctctactaaaaatacaaaaaatttagccgggcatggtggcacacgcctgtagtctcagctacttgggaggctgagatgggaggatccattgagcctgggaggtcaagactgcagtgaaccgtgatcatgccactgcactccagcctgggacacagagagagaccctgtccccaaaaaaatatatatacatatatatatatataggcattttaacggaagtattaccaataaaatctttagcattagaatttttaaccttattaattcatttatgttctacctcattccaaaagcaatttgcagctgctcaaatatctgtgtaatagattccccttgaggattaaagaccggggcttctctaattgtattcccataagcaaactggcaaggtctaacagggagggccttactatactatcaaataccctgcttgggactgcagagaacattgacaaggacgtccaaccctaaagggtagcaggaacaaacaaacaaaaacacgcaaagatgctgttgcacgtagaacacagccaagtgaatccattttcctgctcgacaggtcaagtttgtttgtttgtttgtttgtttgttttgagacaaagtcttgctctgttgcccaagctggaatgcagtggggtgatctcagctcactgcaacctctgcctgccaggttcaagcaattctcctgcctcagtctccggagtagctggggctacaggtatgtgccaccatgcccaactaatctttttgtatttttagtagagacggggttttgccatgttggccaggctgatctcgaactcctgacctcaggtgacccacccacctcggcctcccaaagtgctgggattacaggtgtgagccatcacgcccagcctatttttataattctgtatatacattcatgtgtgctaaaaaattaataactagaacaggcctttaatttgatagatctatttcctttgttaataaataaacaagtgttgagatttaagaggtatgttctaaatattaaaaaatggttttaagcatagcacttggatatggcaagaataagggtgtcaggaaaacattggtttcccatggagatgggtctggttcacactctacccagccagtgaagggcagggcccatcctcctaaggcatctgggactgcaaagcttcatggagtcaggaaaaggacatacatgagagtcactagcaacccacaagcctcacgctgcaaaaccctcctctgcatctccctgagaaacaggtctcctatgtccacctcctagtgccaccaatcctacctccccagtgtgtgaaacaccctgcacctgccttgtcctcccaatatcatgaatgccacggccacccacctggtggctcaaggccaaacacacctggatcattctttttgtttttgggggggaggggggcggggagagagatggagtttcactcttgttgcccaggctgcagtgcaatggtgcaatctcagctcacagcaacctccacctcccgggttcaagcggattctcctgcctcagcctcacaagcagctgggattacaggcgcccaccaccacgcccggctaatttttgtatttttagtagagatgggggtttcaccatgttggccaggctaatctggaactgcagacctcaggtgatctacccacctaggcctcccaaagtgctgggattacagatgtttgagccactacactcagcccattcttaattcctcctttgctctcatgcctgaatttacccaaatcttcaggaagaactctgcactcctcttcctaaacatatcccaaatctctgcactcatctccacctcccctactatcaccctagtccatgcatctcaacagggaccatatggcccccaacggggcaaaaataatttttagggggtgaaaaaatcttatcttactattccttttatgtacaaagcactctgtgtgtgtgtgtgtggtgtgtggtgtgtatagacagtacataaacagatctacaatattttcaaatttcatgaaagttcactcttaggtaagtacctatccaaaattgaaaataggtacacaaacaaatccttggatacgaatgtgcacaagcagcactgttcacaataggcaagaggtagaaacaactgactgtccatcaatggacaaactgaagtatccccacaatagaacgttaccgagccataaaaggaatgaagttctgatacgtgctgcagtgtggctgacttgaaaacatgatgctaagttaaagaagccagacacaaaaggccccatattctttcatttcactgaaacaaaatacccagaataggaaagtcagttcaaacagaacacaaattggtggttgttaggggcaggctgtggggtgagaggtaggggtggaagtttgtgggggatggggagtggctgtttggtgggtacagggttttattttggagcgatggaaatgttttagaactagacagaggtggtggctgcacagcactgtgaatgcactaaatgccactgatctgttcaaaatggtaaattttatgttatgtgaatttgacctcatttttttaaaagatctcagggggagtaaataggaagaaaatgtctaaaatggttcagggccggggcggggggggggcaattaaaagactgggcaacactgccctgcctatcatttcccatggagaccccgtaagcacttcccacaggtctccccaccatgtgcacagcacccttcttccagggcactctccacacagcagccagggcagaacccctgaaatgagggcatattgctccatcacctaaaaacatccagaggcacctcattccccagaataaaatccaacgtcctctccaacctcaaacccaacctttcctttctacctcctggaatgtccggccacagtgacctgagggccaccctggaagatcaagtctgttcacacctcaagcctttgtgcctgaggttcccaagggaaggctttcacgcccaccctagatcacactggctcgaattcctccatggtcaggtcccagctcaaacatcacctcctcgaaggcctcccttgttggccacctaaagtggcccagtgcctctggcctactgtctttccttttgacatgaaaatattggccctgaaagagcaggatctgcgctggccagcaggcatccaggatacctctggatgcttatcaggtgcataatacattcactgaatgagcagtgcataaaataattgaagaaggaggtttccatttctcttctcactgctgtagtcatgataagcaataaacaaacaatgacgaggccggtcgcagtgagtctcgactggtccaacacttcgggaggcggaggcagatgcatcacttgaggtcaggagtttgagaccagcctggccaacatggtgaaaccccgtctcttttttttttttttttttttcagaagggagtctcgctctgtcacccaggctggagtgcagtggcacaatctcggctcactgcaggctccgcctcccgggttcacgccattctcctgcctcagcctcccgagtagctgggattacaggcgcccgccaccatgccgggctaattttttgtatttttaatagagacggtgtttcaccatgttagccaggatggtctcgatctcctgacctcgtgatccgcccgcctcggcctcccaaagtgctgggattacaggtgtgagccactgtgcccggccctggtgaaaccccgtctctactaaaaatacaacaagcagtcaggcgtggtggtacacgcctgtaaccccagctgttcaagaggctgaggcaggagaatcgcctgaacctgggatgcggaggtggcgagtgagccgagattacaccactacactccagcctgggtgacagagactccatctcaaaaaaaaagaaaaagaaacaatgacaaccagataaaacctttttcatacaaaaatatcaaacaatctccccaatgttatacacctactaaacacaaggtgcttgctaaaagagtgattaacaatccaaagaagagatatgacaaggccggacgcagtggctcacacctgtaatcccagcacttcgggaggccaaggcaggcagatcatctgaggtcaggagttcgagaccggcctggccaacatggcaaaaccgctctctactaaaaataaaaaaccagccaggtgtgttggcacatgcctgtaatcccagctacttggggggctgaggcaagagaactgcttaaacctgggaggcggaggttgcagtgagccgagatcatgccactgcactccagcctgggcaacagagtgggactccatctcaaaaaaaataaataaataaaaataaagaaacagatatgactaagcagatcacaaaaaaatccaagtcaatatacatgagggtgtgggtggtactggcatggaggccagagatggtgctcagcatcctaggtgcacagaacagcctcacaatacagaattatctggccttaaatgtcagtggtcctgaggttgagaaaaacctgcttcgaatcactccagacatttcaaaagcaaaaagacttggaaatgcttgtttcaattaaaactctgaaacagatgccaatccttttataaagccatacattttgcccaaaggaagaactaattgcctctgaagtcacaaataattttaccagatttcatattttgatgtacaattcacaagtgtgggctgaaacacatcatttattatctacatttacaaaatcctggcctgcgtgaagggttgttctgactacagtaggaaacatgagccttggaattaaattaggaaaaaaatgccctttccctcccatgcaccccagcactctgggtggggtggaaaggcagagtgaatgattcacgctaaatgtcctccagttataaaacctcagaaacaacctgtatgttcaaagtgccgcaccttgcacaactcctatggtgccatgcacagatgagcagagcatggccagatggtctaggatgggtcaggatgtgttggtaaaaatgctgttttgaagggttattcactaacacagaaacatattcagaatacaaggctatggaccaggcatggtgcctcatgcctattatcccagcattttgggaggctgaggcaggcagatcgtttgagcccaagagtttgagactagcctgggtaacacagcaagacatcatctatactaggtgtatagctaggtgtggtggcgcacacttgtactcctagctactcaggaggctgaggcagcggggactgcttgagcccaagagttgaaggctacggtgagccatgatcacaccactgaactccagcctgagtgatagagtgtgaccctgtctcttaaaaaaaaaaaaaatcccagctactcgggaggctgaggcaggagaatcgcttgaacccaggtggtagagtttacagtgagccaagatcgcaccattgcaccccagcctggaagacaagagtgaaactccatctcaaaaaaaaaaaaaaaaaaagtttttttaatgtataaaaataaaaaattaaaaaagaatacaaggttaagctttaaaaaaataaattctacagtctacaccagacattgcaaacaggtgatccatgaaccaaggagtccacaggtgcatttaatgtgatgtagcttttatttagttaaaaatgtgagccagtacataaaagttgatagctgggtgtggtggtatgtgcctgtagccccagctactcaggaggctaaggcgggaggatcgcttaagcccaagagtctgagaccagcctgggcaacatagtgaggaccctgtctctgaaaaaaaaaaaaaaaaaaaaaagaaagaaagaaaaagaaaaagctggagtagttcccattttttttaatttgagggttctcttgaaaaaacagaaatcggccgggtgcagtgtctcacgcctgtaatcccagcactttgggaggcagaggcgggcagatcacgaggtcaggagatcgagaccatcctggctaacatggtaaaaccctgtctctactaaaaatacaaaaaattagccgggcgtggcggcaggcacctgtagtcccagctactcgggaggctgaggcaggagaatggcgtgaacccaggaggcggagcttgcagtgagccgagatcgcaccactgtactccagcctggacgacagagtgagactccgtctaaaaagaaaaaaaaaagaaagaaaaaccagaaatctctcaatacagagcccatactcctatgtggcaagaaccagcaggaggaaaaggtccctggtctctttcagaaaggcacaactctctagctcagcgtcttgggagctcatgacctattagccgtgtgtaacacttatgggtaacatgggtgtgtaaaacttacccaagagctactgactcttctgacacatggtgcatgctagcatttgccctattgtatttccttatgaaagagctgcttatcattgtagcactaaagtagccccaagctgctgtagtacctctagcatgcactatgtatcagaaaagtccgcaccccttgggttaagtgttatacacccatatgcacacaaaagcacacgatgtgtaacaggtatggaaagaaacgtatgtctgctttcattcatcccagtctctacctaccactccccaacctcactcactgccatatctgcctgatccctgtatttgagctttcagcttaacagtaggacttataaccacatataaaaagcgctggaaacacaatctaaggactggctgtgagaggtgagattctcagtgactttatttcattgactgatcgattgagatggagtctcgctctgtctcccaggctggagtacagtggcgtgatctcaagctcactgcaacctccacctcccgggttcaagtgattctcctgcctcagcctcctgtgtagttgggactgcaggcgtgtgccaccacgcctggctaagtttttgtatttttagtagagacggggtttcgccatgttggccaggctggtctcaaactcctgacctcaagtgatccgcccacctcggcctcccaaagtgctggaattacaggcatgagccactgcacccagccatcagtgactttaaattctgtaataaagaactaatttatgacaaaaacatattgatttcacaattataaaaaaaggggggggggagtaatatgaaacctctttttttttctttgagacagagtctcactctgttgcccaggctggagtgcagtggtgcgatctcggctcactgcaagctctgcctcccggattcaagcaattctcttgcctcagcctcccaagtagctgggattacaggcacatgccaccacgcccagctaattttttgtatttttagtagagacggggtttcaccgtgttagccaggatggtctcaatctcctgacctcgtgatccgcttgtctcgacctcccaaagtgctgggattacagacgtgaaccaccgcacccggaccctctttcctttcttaaatggtaactcacagtgtagctaccagaccaaaggaccattagcccagagggtggtgaatgtcaggccccccgactctgaccctaatacatattaataacttacatcgagatcgcgcaaacaaataccggtgaaggtaaccattctggccaggaggtctatataaaggggaaactacaaaaatcactcagaatattaaccacttaggccacctagctagcaagattataggacactgtgagttaaagacttctggctgagcaaagtgcttcttagaaagctaaatatccagttctaaggattataggcacacagctctgagttctccaatcttctaaacaaaaacaagatttctacactgttgtacaagttttatgcaataacatttcaatctgtagttttatgttactggttacaaaactttcactggtgaggctactatattattttctattctatgacatggcaattattttacacgattttgggtgaactactgtcttatctcaattatattatcctgactgtggaagcattttaatacaaatttcccatctccctccactaaatgctattatcactgctaacagcagatggcagtagggtgcagagaaaggaaacaggtatggatgcagaatctggctgtggggactttcacacctcccttacactctgcatggctctcaatttgccttctgtaaaatgactcagtttcttctaatcctcttagtctgtaatagtggttggcaaactatagctcaagggtcaaattgggcatatcacctgttcctgaggggcctgcaagcgaagaaaggtattttaacatttttttaatggttggggggaaaagaattaatagctcatgaaacatgcaacttatatgaaatttaaattccagtgtctggacacctcgggagactgaggcgggtggattacctgaggtcaggagtttcagaccagcctggccaacatggtgaaaccctgtctctactaaaaatacaaagaacatctgggcatggtagcgcatgcctgtaattccagctactcaggaggctgaggtgggaggattacttgaacccaggaggtggaggttgcagtgagccgagatcgtggcactgcgctctagcctgggcaacagagcaagacttcatctcaaaaaatataaaaatttaaataagtaaataaattccggtgtccattaaaaaagtcttaactgtctacggctgctctattttcttctatctagctagctgtttattgagctagggtctcactctattgtccaggctggagtgcagtggcacaatcacaggtcattgtggcctcaaactcctaggcttaattgatcctcccagctcagcctcctcagtagctgggactacagcagcttgtggctacgttactgcaacaatgactaaatagttgcagagttggaaaaaagacccaaaaagcctaaaatacatactatctagcccctgacagaaaagggggcaatttgtaagagtaaaataattttcaatatcactctctcttcctacactacacattggctaattcatgattagtaaaatgacctaagcacataccagcaaggagattatattttaggaaagggactttaaagtctactcaaatgggggattcaactaacttctcacctaaaaagcactcaaagaatgaggtatatttttccaggaagtctgatgtcatttatctttctccttttgtacctcccaagggaagacagaagctaaattaaacacattatccctgttcttatattcctataaaactgaattttttgaaatgtggtgcaggagaaccaatggtcatatatatgccatgtttcattttactagttatgtattaatttcacatatattaggaaaagccacaacaagcaatttaaacacacgagcctatacattgtgtttagcttaggacaaagctgcattacaattttcatatttaagtatgtaataaaatacggcagaaaaccatggcaatgaaagttcaggcaacactaattcacaaagtcgctgccaaggttaaaattttaaacatttcctgaaaagcatgctctttatgggaattaatgtgccgaaggattgtgtaattaagtaccatgttttgtgaacttggcttaaatggaaccgtgtcatgaaacaaagtaagcttttaaggactctggtcagaaacaagggggtaaaaaggaagacttttctgaaactgtgtcaacacaaattatgtcaattccaaaacaaagctctatgactcaaccatgagtgtctaggaccacacagctatgaatcagaactagagaaagatatagactgcagcctttattttacagaaccaaaagccacaggctctctctacccctcctaccaccatctggggagcagctagaagcagttcttgaaaataacccaaggaaaagaaaaaagaaaaaaaatttcccaagaaacaacacaagcaaagtcagtagaattatttgagttcacaactaaatcctcattattttaactcttggggacattcatggtatcctgaagaactgatgcttgctccttaaagaattcctgtgtgaagggagtgagggagagagggagggagagagagagagaccaaggaaggaagcgagtgtgaaaggctgtccaaggctttaggccagaagcctaaagctggtactccaacctgctttattcattctagaaaatcttccaagacatcttaaactgacatttaataattggagattttacttaaaaacctgacatttaagaattggaggttttacttaaaaactcagactttgggccaggcccagtggctcacacctgtaatcccagcactttgggagcccaaggcgggtggatcacttgaagtcaggagttcgagaccagccaggccaacatggtgaaaccctgtctctactaaaaatacaaaaattagctggacatagtagtgcgcgcacctgtaatcccagctactcgggaggctgaggaacgacaatcacttgaacccaggaggtggaggttgcagtgagctgagatggtgccactgcactccagtctgggtgacagagcgagactatgtctccaaaaaaaaaaaaaaacacaacacaactattaaaggatatgacctttaagggaatgggatcacactgggaagacagagtactattattgttttttacctttttttgtttttgttttttgagacagggtctcacaaggggtcacactttgcccaggctggaatacaacagcgcaatcatagctcactgcagcctcaacctcccaggctccggcaatcctcccacctcaactatagtcccagagtagctaggactatagacacacgccaccacgaccagctaatttttgtatttttggtagagacaaggtttttgccatgttgcccaggttggtctggaactcccaagctaaagcaatctgactgccttgccctcccaaagtgctgggactacaggcatgagccacggcgcctggtcaagtattattttttatcatatgtgtttctctaagatttgcactgtttaatatgaatgtagggttttgacagaaaaatacaatttcaactaaaacaaaattatttgtgttatggaaagtcaataatccaaaatgcagcgacatctgaacagaactccacaagatttctggccatctccatctacttctaggtataacctccaggtggccttttggggacacttttctcatttctgggttactagcagcaagaactccactggtgacttcttgaaaatctgctctgtggccccctacagttccccacgattgcttgatgctcacctgcttgggcccaccaagtgtgcacccatgggaaacccccgtgtccaaggggcctcctccccgctcccccgcacggagctgacctgtgctcttatccaggaagtccatggactcctcgctcgcactgaagtggctcgacgtggccttcttctcagcatcctgctccacgtcggagcccgtgtgcacagaagagtttgtgctcatgggggagcgcggcatatccgacaaggaaatccggcggcctgtgcccccactcagcacaggcttgctcatcaggatcttgggggatgccgtcatgtcaaagttgagcttgaccttctcctgcttgtctatcttggcagtgccggcgctggggttggtgggatcgagcagcatttgatactggctgttgggtgtgtagggtgtcctaaatggagagtaattaaaaaccccaaacttcctgcggatgttctccacgtaaacctccatctcttgcatggcactgttgaagatgctcttagtctttttcacagaaaaaggaatttctttagacatgaggtagcaattatttattggaacccaggccctagaagggcaaaagataaagagagtttaagtcaacttcagtaatttccaagattgcttttttcttgatgtgaaccaaattagccaagcatgtttgccaagattcttattctattaaaaaaaaaaaaaaaaaaacttggtttgaaggattaattaatgatccatttaacaagcatgttctaccataacagaacatgaacaacaaaacttcggcgaaaacatttaaaagtgcaacagacttagtcattgtgagccactaaagaaacaatcctctttggttttctcttagtagagaaaaataaatcagccactgcatctgacaacacctctgaaaagagacttattcctcaggttacactcagacataaaaagcttccttttcccattgccatttgaaataggaacagaaggaaactttggaatactgcatccctaaaaggaggtacatgtttttgaatgtaagataattcacacagaaaatcactgaaaaaggagcccattcgcctccaggcgtgcactttccacctcccatcccaggccagttccatcttcctaacatccatatcccacattccaattttgctctgcaaagacccatgacagcatgtttttgcagaacaaacaatgccagcagcagcttttctggaaccagagccagtggcccccgggggaggtgcaaacaccacaaccgctgctgcgggtgaccacgcagctgatacagggacatcccagaaataacttggctaccatgtatgatctgctggcctcaacccagtttctggctggaaaaactggcgagaataagctttccaaggaaggcttttgtgggggattttttgtttgtttaattaattcattttatttatttatttatttatttatttatttatttatttgagacagtctcgctctattgcccaggctagagcacagtggcatgatctcagctcactgcaacctccgtctcctgggttcaagcaattctcctgcctcagcttcccaagtagccagaactgcaggtgtgtgccaccacgcccagctaatttttgtatttttagtagagacggtgtttcactatatgttagccaggctggtcttgaactcttgacctcgtgatccacccacctcagcctcccaaagtgctgggattataggtgttagccaccgtgcccagtcttttttgcttgtttttttaagagacaaggtttccctctgtcacccaagccagagagcagaagtatgatcaaggctcactacagcctcaaactcctggactcaaggaatcctcccagatcagcctcccaagtagtggaagtacaggcacgcgccacaacacacccagataattttttaacttttgtatacttttgtagagatggggtctcgctacattacccaggatggtcttgaactcctgaactcaagcaatccttccaccttggcctccccaagagctgggattataggtgtgagccgctgcacccaacctccaaggtggccttttagatttcacagaccacaaactgaagcccggtagaaagcagtggggagcaaaggggactttgcagaagcagaaaactcacgtctggtggaaagggagaaagcagtatctactcagttgctatccaaagcaaccatgtaggaatctggacccaacactgccacgttttccaatattttaaagagaagaagacaaaatagacttcttatgttacattttacccccatttcaacagttggcatctaagagaaaacaacccaggagaaataaagcacatccctgggaccgaattcacaatacaggcggattgtttgcaagtctcggtgacaccagatcgtaacacaaactaaaactaaacaccccaaaaatatcgatctgctctatcagagggctggaaatcaccagcttctcatccattctgactgctgtctttctcctgagacctgaagaaccatatctccaccaagaggggcagagcagaacagaagccagatgctctcaaggtaagagtttgcctcacggtgagattctgcgttcaaagtgagcgggcacagatcaggactactagacaggacagatctgagaaggcatcagggtctccagtgctgtcctagggcaaatgactcccccttcctgagctagcctcagctctgtcaccgagaaaaaggagagtgagtccttctctggagaatcaagaggcagggccaccaggagcttatcaccagttggtcctggtatcataacctcgcccccctgacctgctccacacccacctcacccacacacttctgtccggtatctaaggcgctcactgttcccttcccccaactattttccatgaaattgcttggcagggaaggaaaagagtctcttttctttcaaacaagtccaaggctgggcatggtgactcacacctataatcccagcacttggggaggcagaggcaggaggatcacgtgaggtcaggagcttgagaccagtctggccaacacggtgaaaccccatctctactaaaaatggaaaaattagccggatgtggtggcacgcccctgtaataccagctactcaggaggcagaggtgggagaattgcttgaatgagccactgcactccagcctgggcaacaaagcgagaccccgcctcaaataaataaataaataaaacaagcctgggtgacagagcaagacccccctcttaaataaataaataaataataaaacaagcccaggaagtatttcaagcgaaattagatttgcttgacaaaatagagtctctgcgggggacaatatctagtttcacattatctcacatctaaccccacggtggcttctccctagctatgtgaccctaggcactctctgaccttaagttttcttattgataaaatagacataaaagcagcttctacaaaaaagcacttaaaacactgcccagtacataaaaggcaattggttggtgtccgcttttttttttttttaactctgcaggcatttaataaaatatttcctatatttttacataactgtgcatctataaaacaaaaccaggccaggcacagtggcttacgcctgtaatcccagcactctgggaggccaaggcagatggatcggttgaatccaggagttcaagaccagcctgggcaacatggcaaaaccccatctctactgaaaatacaaaaaattagttgggcgtagtggcacatgcctgtagacccagctacttgggaggctgaggcaggagaatggctgaatccgggaagagaaggctgcaatgagccgagagctcgccactgcacacaccagcctaggtgacaaaccaagactctgctccaaaaaaaaaaaaaaaaaaagaatggtggtcagagactccctgcccaaagcctactaaaacatcccaagacctccaaagttgtttctctaccactgtggaaggtcctgaacaactccctccaggggatcccctctcccaaaacaagcccaacaacacggtgcactcccttaaagcaggtgctgagaggggcttcgaaactggtgaccatcagacccatgctgctttctttttcacaaacagaagggggccagcttccacgacagctctcatccagaaccaagacctaaacacacaaatggttttgggaaacagcttctgcacacagagctggccaactcacacgccgtccttcatgctctgtaagccaccttcagtcgctgtctgacgggtgagagatggaggtccctgcagagcagtcacagctgagagactacagccatcaaccataagggtctgggaatattgggtgcaagggggtaggtattattttttcccatcctgcctgtgtcctaagtatatctactcatactgtattactgtatcaacctatagagtaagaatctcaaatcatcaagatggttcacatttgtcatgctctgatgaagaggagggatgtacagcctgtcaccaattcctcctgctcttcaaataaaaaacaaactcctgcctacccctctgactccagctgtgagcatcctctcctccccgaccctgtttaaaccccactattctcccagcatttcctgaaccctctcagcctcagcccttcccctcccgacctctgctcttcctggtccctcatcccagatcttcacaccaggcccccaccactacctcctgacctgagattatcttgcctattagttcacttgtgtatcatccttcttccccgctaggatgtcagccttcacatgggcagaaacatttgaatcaccagcttccactacacaggctggcacgcagcagtcatcaaatatgtatttctttgaatgaaggaatacaggaattaaagtcaaggtgcaatacttcctaccaaatccagcaccatctcaataatttccattttgtcttctgacagtggaccattgggattcctagtaaatgagtttgcaaatgacttgggaattcactcttttggtctgcaagacgactagcaaaatttaacaggggaaaccaattttcagcttctggacactctgtgtgtgtacataatttgtagtatatatattttaagtagtctcgctacatactaacacgctttctcaaactgattggtagggcttcaaaagggtctttgccttacttaatcataacttgataaaagagaactaagatattaaccgctgctcatctctgcctacctgttgttctcaagcacacagcaggctctgctctacagggaactgctattagctggaataattcactctgccgtgtacggagggaaaggggagggcaggaaggctgggagggagggctcacacctgtcaaaacagcaaccccttataacttcccactgtagcttcagagaaaagggaacaggagagaactactcagcatgatgataagagattcatttactggcaatctaggaaactacttctattctttgaaagaatgatttggaaagcagtttccatggaggtttaatttacttcagaaaccccctcccaaaaaatcaaaccaaaacaaaaaagaacagcagcacttcaaacagccacagaacccattccaatgttggtttcatcaacagacccagtaaagtaagatgattttctaacacacctgagaaaactgtagcccacgccattaccaagcttaacataccacaggaaatttatttcaacaacaagatcaatggttggtatcatgacaataatgagaataatagctgcagcctccacttcttttcttatctcataacagtatcaaagttcagtgaaagctacatgttccaagcctgttattaactcccacctgtcatgttgtccaaagaatcgggcatcgacctgcccgtctttatcccttagagcttttgcaggccagaatggaaaccccttcagtttggcccagaccaaaggatgtggattgctctaggaaaagaaaaacaagatccagagtttgtacatatttgacagcaagatactcactaaagtttggtatgtgaggatgaagcaggactgtgggacacaggccatgagtggaaaaagagtttcaagcagggtcggcctgtgtggtattccctaaaaggtatgtggccaagacacctggacaaaactgcaaatggagttaaatggtgaaatcaaaagctgaatgaagtccaggcatggtggctcacgcctgtaatcccagcactttggaaagccaatgcgggtggatcacctgaggtcaggagttcgagaccagcctggccaacatggtgaaatcccatctctactaaaaacagaaacattaaccaggcgtggtggcacacgcctgtagtcccagttactcaagaggctgaggcaggagaatcacttgaacgcaggaggtggaggttgcagtgagtcaaatcacgccactgcactccagccagggcgacagatcgaaactccatctcaaaaaaaaaaaaacaaaaaaaagaaagatgagaaaaccagggttggattctagctgtaccattattatctgggcaggcacgagcaagacatttcacctttctgtgcaacatacacagagacaatgacaccaataccttctgtttttggattaaatgtgcatcatacctagcatctaataaggggcagtattttgctacctttattctttattgaaggcttagctattccggtgttaatctccaaaagcacgaagagatgcaaagtatattttctcaactttccttgcctaatcttgcctccaaacccactccaacccaccaaccccacccccaacacacacaccagtgcagcccaacaatgtacttctctctgcagaaccccagcttggagaaggcagatccacagggaaactagggtgactttatttcccccaagaatcatgttttggagggactatggagttaatccagggaagtattttcaaacctcttaaaatagaaccaacatgatttgtaaatccacactgatttaagctcatcttattatctgaaaagctttgctgcatcccacatctctgatgagctctcttttatgctgcaccttgcagtctgcccaggctaatcaacccaggaagccatgatgctatctctggcacatgaactttcagcctaagaggtttatcctacctggattactttccttctgccataattttatcagcaaaaaattatcttaaaactccatccaaagtttcatctaataagccacctggaaaaagctgtctcagggtagtcatccaaggcacagggttcagtaaatgaaataagcaaagtaaatccaacttacacaaggctcacaaaaccagttatctcgtttttggcaagcagctagataacattctggacatacttcgatttcattcatctgtaaagcaaaaatacattagaatgtgtcaccccaggggtggatatcttgtggacctcaatcaatgcttgatgattttgaaggttaagatgttttaaagtcccatagagggaacaccttggagatgaatccaaccactatgtatcgctcccaatgcttccacccagtccaagccaccgtcctttctctctggaccaatgcaacagctaactccccacgtcacccacttccacttttacccccattatagacattccctgcagagcagccacagccaccattttttttttttcctccagagtctcactctgctgcccaggctggagtgcagtggcccgatctgggctcattgcaactttcgcttcctgcgttcaagcaattctcgtgcctcagcctcccaagtagcagagattacaggcgtgcatcaccacgcccagctaatttttgtatttttagtagagacagggttttgccatgttagccaggctggtctcaaactcctggcctcaagcgatccacccgtctcagcctcccaaactgctaggattacaggtgtgagccaccatgcccaacccagagccaccttttatagacataaatctgttcttgtccttcccctgcttaaaagcccccagtgacttcccattatacccagtagttctctgtcagagcactttaaccattccccccacccacagggatcacatagcaatgtctagaggcatttttgattgtcacaagtagcccaaaggagggatgcgggactactgaaatctaagatgtacacaatagtccctgcaacaaagaattctccagccctaagtgtcagcagtaccaagctgagaaactaacaatgaagtctaatgacctgacaggttccctcaaagccacatgtgatctggccccagcccacctgtctcggctcaccttgcagcagttccgctccccaaccccttccagccactctggcctgctctgcttgccaagctcaattctatgtccagagtagctaattaataccatgttgccctatttcagctccactgacgacaatccgaaaattcaattaacttatttattgtccttttctctcataagaaagtacattcccctagaataacattgtagcttagagccaaagatcccagaagctcccttcttggatctcaagtcagactccaccatttactagctctgtgactttagggtaagctgcttctcttctcagagcccccatatgttgatctattgaagagaaaaaaaagcagcacccaccacaaagggctgttataagaaattaaatgagataaatgtaaagtgcttcaagtgacagagtaatcaatattgcccattaacatttactgaagacttagagtgtgctggtatcattctaagaattctgtaagtattaactcattgtattccttacacctcatgagattaaaaaaaaaatgaggccccaaaaagtttagtaacctgcccaaggtcttacagcaacaaagtggcatggtcaggatttgaacccaggtagtcgggctccaaagcccatgcaggtcaccactgcactgatatttgttattcctttctaccactatctgccttattcttctctttaactcttatcatgcaaggtgccacatatttaacaggtgctcaataattataagactaacagatttcacaggtcagcgagtaagtaagcgaatgaatgtgcaaacaaatgcatggatggcagagtgcacctcctgcttctaagcccactctacttctgagctattccaaaggaacatatccaaaacagcctgtatgactttcttcaaggaaatgcaaactaaaatcacagtaagatgcctaccgtttttacagatcacatcgttggggcaggggggcacatatttacatatagttttgtaattacaactcccaatattggaaaggacatagcctcattgtaactggaacatctgacatgttcacagcctcatagtagttttattcctaaaaattaaactaaggaaatcatcaaatgcgcaatgatattcatcaccttgttacttaagatgctgataaaactgggtactatttaatgacaagaggagtaattaaatgaatgtccatgtgttgtatgtaatactatacagccatgaaaaattctgttcttcctacgagtttaattacctaggaaacagagaaaatacataaaataaactaagtgagaaagcagtttataaaactctctctacataaatatacagacataagccgggcttggtggctgaggcctatattcccagcgtctttggaggctgaggcagaaggatcgcctgagcccaggagtttgagaccagcctgggcaacatggcaaaaccccatttctacaaaaaaaataataataattaatttaaaaagaaatagccaggctaattaattagctgggtgtgatggtgcacccagtccatgttgagaccctgcctcaaaaaatacatagataactatatctatatatagatataaatttataaggatagattttttttttttttctcggagacagagtctcactctatcacccagtctggagtgtagtggtgctatcttggctcactgcaacctctgcctcccaggttcaagcaattcttctgcctcagcctctcagtttagctaggattacaggcatgttccaccatacccagctaatttttgtatttttagtggagacggggttttgccatgttggccaggctggtcttgaactcctggactcaagtgatctccctgcctcagcctcccaaagtgctgggattacaggtgtgagccactgcacctggccaggtatctatctatctatcatctatctatctatctggatatatctagatctagatctatatatccatatataaaaagacatggatgggtcccagtgctatctgaacagtttttctttatgaatgaatgggagcacactgacaggttgaaggtcattccatctcatttttttattctcacaatgagatctaataaagaaaagctccctcataccattttggctgccagcctgtcccacaaccaccagagcctcacagctcacacgcctaagaggtctgttccatccacgccatcacaattatgggcatttgcaagaaaacaggttctcctggacacctgggccactctcccagaagcagtcaaggccatgcccccagatatcaaatcctcttctgcaagaggaccaaaagggacctgaaacaataccaggctgtggggccaaggtcagaaattacgaattctatctaggcaatcaggaaaagacaggaggcccggtgcttactggtgactcaagggtaaaaaacaaaaaatcctttccatctcccttagatcattgctacagtaagggtgttttataatatactcgggcccctctttgttctttttactttccttgaagagtaggggtgtggcctcaacaaattccaaaatcacctcggctacctaataggagattctgcaaatggaaacttcagctgccccatcccctccttctgggtgcatctaaaacaggacagtgggaaacacatacctcatgttcacagattttgatgactactttcgctatttgcgtcaatttgtgatttcctaagggaataagaaaacaggattaattctaatggaaataccgcaacaccgggcctggggactttacttccgctaacaatgtgtttacttgcttttcccccaggattaagcttttaaaggctaaaaccagaggttcctggcttctaatagtaattcacattatgtgattcctcccatcaatgtcgacgactctttggcgcctcgatgtcatcttctctgcaactgagcaatttatgtgggtttccctagagatcatggattaatattcttaaaatgctttgacattctaaaggctcaaattaatgaaaaaaggccttattctacccattgtcccagacgccaacccaagaagaatacaagagaaagaagacattttcttgaatagctctggtgtggctagtgcttcaaaacacattttcttcttgggccaagtgtggtggctcatgcctgtaatcccaacaccttgggaggctgaggcagagggatcacttgagcccaggagttgaagaccagcctgggcaacatagcgagaccccacctctagaaaaaaacaacacacacacacacgcacacacgcacacacatacacattttcttctcagctcctcaagaagtcatactaggaagcagggacaaaatgtgcccatttaatgaatgagtatgccaaggttcaggagtcaccacttacattacttagctaataaagtaaccatctagccccaggtctaactctacactaaaccagacgacaagatggtccaaagtcatgttttctttgaactttatggtatttttagaaattgtaaatttgttgacacgaagatttcacacacacaaacacacaatatacctacatttctggtttgccttgaaaactcagaagatccagtaactataatcaatggagcactggagctgccaacagcgacctttccaggccaggtaggagttttctgttctccatgatccacagcacatcacttgacctgcagccttcttggcttgtgctaatgtttttgttcttctacctgacctcatccacttgtttatataatttgataggcggggcctttctatatatttgagtttataatctttacaccaattcttttttttttttttttttgagatggagtctcgttctgtcacccaggttggagtgcaggggcgcagatctcagctcactgcaacctctgcctcctgggttgaagcgattcttgcgcctcagcctccagagtagctgggattacaggcatgcgccaccacacccaactaatttttgtatttttagtagagacagggtttcaccatgttggccaagctgatctcgaacccctgactgaagtgatccgcccgcctcagcttcccaaagtgctgtgattataggcatgagccactgcacctgacccacacattcttaatgcctagtgcctctcctttttcccctccttgcactctcagccctgctatagttagtaatgcaatatggtgcgtaaagcagatatgcatatatctttccttaaacactagcaaacaggctggcgtggtctctaatgcctgtaatcccaacactttgggaggccaaggtgggcaaatcacttgaggtcaggagttcgagaccagcctggccaatatggcgaaaccccatctctactagaaatacaaaaattagccaggtgtggtggcacacgcctgtaatcccagctactcgggaggctgaggaacgagaatcgcttcaacccaggaggcagaggtttcagtgagctgagatcacaccactgcagtccagcctgtgcgattcagtgagactctgtctctaaataaataaataaataaataatcctatttttgcaatgaacaaaatatctgaatagatgtttacaaaaaatgacatacaagtcactaataagcacaggaaaagatacgcaataccactgatcattaggaaaaggcaaattaaaacatcgtgacataatactttacaccttcaagaacaggtaaaatttaaaaggcagacaatatcaacccttatagtgtgtggagcaaaagagaactctaatataccctgctggtagaatgtaaaatgatagaaccactttgcaaaaactgtttggtgaaacgtagtaagttaaataaaatcctactcactgagctggcaacaccactcctaggtatttacccaagagaaagaaaaacctatgtccatgcaaagacttgcacaagcaggttcacagcagcttattcctaacagcccaaagctaagaacaacccaaatatccatgagcatcaacaaggtaaatggatgaatggcggcatattgatcgaatgaaaaaaaaaaatcagcaacaaaaaaaaaggaaccactaataacacataacacagatgactcctcaaaatattacactgcatgagagcagccagacacacaagagcactaactctgactccatttatatgaaattctacaagaagcaaaattaatctatcctaacacaaagcagaaagtggttcctgttgagagtgggtttcctagaaaatggcatgtatgagaatccaacaggctgataggaatgttctggatcttgtggttacacatttgtcaaattcagtgaatataaacataaaatctgtatgttttattttatgcaattatacttccattaaaataaggtttgtagaaataacactaaaaggcagcagcaccatgcagctgcaagccactttagatgtcagctcataccttaaaatgaacttggtcactgcctcctattcacatatattagcacaatctatacgcaagtattctcaatatgaattaagagcctgatttttcatgaaggacaggaatttgtgcaacacatacacagcatactctttcttaggagtcatctaagccactcacccccattataaatgatgcagttgtgcaaaatccactttgcatcagccaggaaggcttctgtgcagccatacattttctttttcgcattctgggaagaaaagcgatggagcataatcacagtgagtctagacaagccacagtcagtgactcttgtgtccccacataatttttgtagcagtcatttgccaaatcaattagtgttcttctattcatttcccaagatgcttctttttaacctacaacaccccgactaaagaatgcttttatttttgagatctataaccctataaaaatgcactctttgaatttaacacaataactggaattttctcatcttatagtagctgtcatttatcatgtagcttcttccaataaacaggatagtttatttatttagttttttttttttttttttttttttggaggtggagttttgctcttattgcccaggttggagtgcaatggcgtgatctcggctcactgcaacctccacctcccgggttcaagcaattcccctgcctcagcctcctgaatagctggaattacaggcgtgtgctaccatgcccagctcattttgtatttttagtagagacggggtttctccatgttggtcaggctggtctcgaactcctgacctcagatgatccgcccgcctcagcctcccaaactgctgggattacaggcttgagccaccgcgcccggccaaacagggtatttcatatatttatacattatttattattagtcatatggtctcacacaaacctcacaataatttaatgaagtacttattatcatacccattttacagaaaggcaaactgagatacagtaatgttaaggaatgtatctaaagttccacagctcttaacttaattaatataaagtcaggtttccaactccatctcttttgaatgcctccttttttccaccacaccatgaaggtatgtgcaatttcctaaaaacagactggatttatggtttgggagttattggggaagacaatatgaagtaatgtttcttcctcgtggatgcatttcactgcccatattttgctgcaaatagttggaaaatcagcatcagaataatgtgcacaatctacagtgttccaagtgtaattttcagcgtggaattttagcatgaacttttaaaaccttcaggcattcaagaaaaaacctaatcagtagagtaagtcaaattctaagaagccacatctttattgctaatctggaggcttcccagacacttaattttctcttcttccttcctgctgctctcattagcacctccgaaagaaagaggaggtaacgctcaagtcaatcaaatcactaactcttagaagctatggcttttgcaggtaaaaagctagaatcatcgcaaaagtattaccaaagaatttcaacattccactgcaatcttggaagaatgttacaaaggaaagacgttagagaatcaagagttcttctatccaaataaaggagcaatgaaaatatagagaaacaatttaagattgttatgtccaacttgtgatagagcataggcagtgagggaagagccttaggcatctcaactgtgggctagaatggtgaggttctttgacggaggccaaccttttccaatgtacaaaggtccattggatggaagatgtattccgcatagtcagggtgctgttccaatggaacgggcttctggaatgcatctgtctataaaagagaagatatgcagaggaacgaacccatcattactatggaaaaccaagcattaatgctaacaaaaggcttgaaaaattgagacaacttttcagacaatatagttctaaagttttccataaaggatgaccgtggggagctccaaattggtctaccttctaattctgcctggttattgataattataagcccaattgtgatccaattttattcttggttttcaatacacactcaagaaacagatcctgtcctcttacattaagattgacaattacaatacgcactgtaagttaaaaagatgctttaacaaaatcagcactttctcccctgactgatttgacgttcaacgatttacttgagaaattaacgccctcttcaatttttcttcttggtttttaattctatggggctgacaaatctacatgactcattctttttgttaatagtcattagcacatataatttagcctatgaaaatcgaaggtaattccttgccacactcaacataaaaattataccatagcaaaaaaaaaacaaaaaaattgtgcaaaccaaactaaggctacaccttttgcttccactgattgagattttgtttaaaagagtccaatttgttaaaggttctcaattgaaggatatccaatcagcatgctctaaattttttttatcatctcttcaaaatttcagaatataatctcaaagcaaaagcttcttttttttttaaagatataaaaccacagtgattagccccaagaatctacatttctgtacagtactctcaggagttgtacaaagggtcaccactagcccctatggtgcctttgtgcaaatcaggtagggggcatcatgtccgcaagtttctcttcatctgtaggggccaggcgccgtgactcatgcctgtgatcccagcactttggaaggctgaggcaggaggatcatttaaggccagaagttcaagaccagcctgggcaacatagcgagaccctgtcattacaaaaaataataataataaaaaagttagctgggtgtggcggtgtgtgcatctatagttccagctacttgagaggctgaggtgggaggatcgcctgagcccaggaggttgatgctgcagtaagctatgactgcgctccagcctgggcaacaaagcaacagtctgcctccaaaaaaagaaaggaaggaagggagggaggtagggagggagggagggacgaggaaagaaggaaggaaggaaggaaggaaggaaggaaggaaggaagggagggagggagggagggagggagggagggagggaggcaggcaggcaggcaggcaggcaggcaggcagggagggagggagggagggaaggacagagggagggaggaaaggaaaatattcatctatagaaaaaatgtcataatatgcttattatattgtcaaaataatactatcttcaaaaacaagttatttttctgccattttcctgaaaagtattgtgataaatatacaaaccacagtggccatggtttgacctgggactcacaggtgaggcaccactgtgaggtacacaactggccaacccttcccccacatgcagattttcctcaaggggcaaaggctgtatatcaaatctcatctcaaaactgaaggaactaaccaaattctcaccctctacagaaaagtcactggttgagttttccttgaaggttccatcatcagatctgggacataaataaactgtgttgtgctcagcttcctcattgaaatggattttcctaactcccatgggaaggagcacaaagctccccttgctgggtgttataggaggtttcactttgcaaccagtcagaattttcaatccccctcaacgttttactatgtcattgcccaattgatatggtttggctctgtgtccccacccaacctcatctcaaattttaatccctacatgtcaagggaggaacctggtgggaggtgactggattatgggggtggtttcccccatcctgttctcgtgatagtgagtgagttctcacaagatcttgtggtttaaaagtgtttggcacttcccaccccccttctcctgctgccatgtaaaacgtgccttgcttccccttcgccttccaccatcattttaagtttcctgagggctccctagccatgcagaactgtgagtcaattaaacctcttttctggcgagccacagtggctcatgcctgtaatcccaccatattgggaggccgaggctggaggatcacttgaggtcaggagtttgagaccagcctggccaacatggtgaaaccccatctctactaaaaatacaaaaaaaaaaatagccagtgcggtggcgggagcctgtaatcccagctactggggaggcagaggcacgagaatcacttgaacctgggaggcagaggttgcagtgagccaacatcacaccactgcactccagcctgggtgacagagcaagtctccatctcagaaaaacaaacaaacaaacaaaaaaaaaaacctcttttcttcataaattactcagtctcaggtaatatctttacaatagtgtgaaaacagactaatgtaccaattaaactcctctgggacatacagtgcttactacgacagagaattaactgaatggcatcatacctcatgtgtgatttacacatacttgaatttggggatgcaaggaggcccaaagaatacatcaggtacctaaaaagctaagctattaacagaacaaaacatatgtcattacgttcatttacgcgtataccaagaggaactttcttcttacccctggctgtttcattttctgaatggcaaacttgagcaggtaggataactgttcaatggtgagcattgtcatggctttactctgggtctcgatgcattctgctactgtaattttctacaaagtcaaagtcatacataaacgtccggttagaaaaaagaaattaccatccatgtactgatttctattttttcagtcaactgacagacaaaaagcaattctcatcccaatgagacttgttgtttcacttagcaaagactcctggaacaaaatgtaccagatcagtgggtaactattaaaaagcgtatcaatctatttccttatcaggaagcatttttagctcaggaagacgacatgatctgagaaaagatgtggctaaacaggggcctgaaaaatcatcattattataacctttaggtttcaagaatgggatatgaaagcaaaggccaggtgggcgtggtggctcacgcctgtaatcccagcacttggggaggctgaggtgggtagattgcttgagccccagtgttggagaccagcctggcaacatgatgaaactccatctctacaaaaaaatacaaaaactagccaggcatggtggcacgcatccgtagtcccagctacttggtaggctgaggtgggaggatgggttgagcctgggaggcggaggctgcagtgaaccatgattgtgccactgcactctagcctgggtgacagagcgagaccctgtctcaaaaatatgtatgtataaaaaaagaaagtaaaggccacggatgatttcagggtgattacttcacaggatgggtacttatcaaccatttatcctgatcctcttaaggttctgggctgtcattcaggaaactgacaaggcattaattcaatgacatcactgatggaaagggacagacttccctgcagaaagattacaagggaaagcagtggactaataatacgtatgacttcattgtccatctcccttactttgaacccacctaaggcactgtgtcaaagtacacaaggagcacaacctaacctaactgtctatctccatgggtaatagatatcagctcctaagggaaattcccatcaaagaagagacccaaaggaacgtctgaaaccagattctgctatgtaaatctggtactacatcttaaggcttcagaatccttatgtagcagcaacaacaaaaatagcaaattctgatcatgtcaggaaacactctttaaccatctgtgtagggagagctgagaaaagttttctccaattaatttggattctgtttccatttttcacatctctggggcctccaaaaggaactctcagatgtgtctcgttggttgtcgaggaaaaggccaacacaagagtcactcagaagctgaaaacagtgcatgacgcatgcatctatttgcttagctaccacagccttgcaacgttcagtcttcccagttgactgccgtaacaactcatccctggaagaaattcagagccccgaatcttagacacagagcacctgtttgtttgattctggtttgtttccaggtaacttatccatggcaaacacttgggctgcctgcccaactatcattcattccctctcaccccccactccttcttcctggctggcagtgcctggttcccacaacacaaaaagcaccacatatgcaattttcaaggcttttttgtacaaggactggtgatgcaatactgaccaatgagcccaggggcaaatcagctgggggatgatggacaaaatctttctgcttgataaaaagagatgcaaggagagacatcctccttttgggagaatttttgtctatccacacataatacctgaaccctagcagtcaacttatggccatggagaacatgtcacctcaacaatgagatggaaagagtctggctctgaataaactctggcctggccctgcctctaggttctgatgataataaatccacattgtttcagcccccttctatcaggaactagtgcttgcattaacaactatattttgttggccgggcacagtggctcacacctataatcccaacaatttgggaggtcaaggtgggaggatcgcttgagcctaggagttcaagaccagcctaggtaacatagcaagaccctgtctctacaaaaaacttagtaagtagctaggtgtggtggtgtgtacctgtggtcccaggtactcaggaggctcaggtgggaggatcgcttgagcccaggtggtcagggctgcagtgagcaagatctcgttactgcactccagcctgggcaacagaacaagaccatgtctcaaataaaaataaaagaactattatttgcagcaaaagcatcctatcagagctgctgtcatctttgtaatatcattaaacaattgggaaaagttggccaagactaaagaaaattggtgaaggttccagatcccatgacaaatgtagtagaatgaggtcagcctctgcgtgcagaggagggcgccgctgtacaatgcaaaccctacatatttctccatctagagtaacccaaagagaacggcagccgccttttgccattttagagaggacaccattacaatatcatcgtcatcatattgatttcatgtctactttctttttatgtatttcttatttttctcctctccctacacaaaagtatgacagacactgtcctatagctggcttttttccctactaaagacatctggatgatctttccatttcacacatagaaagcttccacatttgagatcaaactccaatgtaccttttttttttctttttttgagacatgatcttgctttatttcccaggatagaatacagtggcatgattacagctcactgcagcctcaaccatctcggctcaagtgatcctccaagctcaccctcccaagtagctgggactacaggcacataccaccatgcccagctaatttctttaaactttctgtggagatgggggtctccctatgttgcccagacaggtcttgaactcctgggatcaagcaattctcctgcctcggcctcccaaagtgctgggattacaatcatgagccaccacgctcagcctccaatgtatctttgaatccaagagacattccacattaaataattgtggagatgacatttttattttcagcaattccaaaaaaacatcagagttgggggtctccaagaacaggagccacctccaaacagtggaaaccctaatagttggcttaataaagggtgcctggggtttgctacacaggaggcatacacactgccccgactacgcccatgcactgctgcctccggccgtctgcctggaagttgtcccccaaatggctgcatggctcactcctctctttcatcaagtctttctcaaattttagtgaggctttcccagaccaccacattcaaaatgaaaacaccttgcactcccttggacctcctattcccatcctgaatttgttttcttcacagcacttttcttttaattcattatatggaactttatttattttggtttttgtccttttctgctggaaaaaaaaaaatgatccatgcctgtttttgtgcactgtcgaattcccagcacctaataggcactcaagaaatacttgttgcacaaaagaaagcaccagacggccactacagggaacatgcaaccaaacgtggtcttctcagcttggctactgctgatgattcaatgatgcggcaggcaacaacatccaagacggagaaaacagaatgagatcttttcaaaatgtgtgagccgttcatgatttgggagttaactttcaaaaagttcatcatagaagatgcagagatgacgactacagatctccaaggaatccaaggactcatgagaaatcagaaataatattccgtgcaattgtctttccaagagctgcagtactgcagccactgccggtgttggtcaagaagggggtgaccaggatagaacaggtggaaagcaagaaatttctcttttccatctatctggattatttgtaaatttaaaaataaaaggaagaaagagaaaggagaggaaacgaggcaggtaatgcattcattcatcaggaactaacctcacattcaggacaaaaccagtccccctctggttccgatgtcagtctcagacacttagcgtgataaacccggggacagagctcacagcaaaggacttggccttcccggtgacaaacccagcagtagaaatcattccgtccatcctgcggtacaacatcaacagggtctgtggtgagtggctgcttcatatagtaaaacggaccatgtcttagttctgactgaaatgtaggcaaaaagacaggtttggtttcaaaacaaatgtgcattctcaaaaggaatttgaacaagtacatcaataacaacaaaagaaaataacagcatttcacaaattcattaaaaagccaaactatcttaggttactctactaaatatataattagcaagttgttaaaattatgaggatttttcttttttctattttaagaggccacgattaaaagctggtatctaagagttacaaggcagccctagcagaatggcacattgcctataacccacatctacctaggttcagattttaactctaccattaaccaggtgcatgaccttggacaagtctcttaacctctcagcttcaattttctcatctgtaaaatggagatgataatgcctaacacttcatggtactgtgttgctattaaatggggtgatataatgtatgcctgtttatcaaaatgccaccatactaacaatgctaatgtggttggaagcccaacttatggaagtcccaatttacaaagccaataaaagcatagtagtttgccctgggattcttcaaatggcagacatttagagaatagatcaatagggtttcagtcaccaaaaaatggttacctaattttttttttctttttctttttcttttttttcagagacggagtctcgctctgttgcccaggctagagtgcagtggcacaatcttggctccactgcaacctctgcctcccgggttcaagccattctcctgcctcagcctcctgagtagctgggactacaggcgtgtgccaccatgcccggctaattttcgtatttttagtagagatggggtttcaccatgttagccaggctggtctcaatctcctgacctcgtgatctgcccacctcggcctcccaaagtgctgggattacaggcgtgagccactgcacccggccagttatctaatttttaagtttacccccaatacataaagcatttatgagccaacaagaggcttcctaaagccataattcttgagcatggtaggtccttgtttttgctagggagacatatctcttatttgacatcagcaatggcagaaagatgagatgggtggccaactcatgggaggtcgacctcttcctggtatattatggaatattatggtatattatggaatccagcaaagccacacttgaacacaaaaactcactcaggagaaactcataatgaaaatgtctatcagaaacaaatacgaaatcctatttaggaagtacacatgtaagtcctgtgggaagattcaaaaagacctggtaactagctatgtgaccttaagaaagtgactcaacccactttgagcctcaattccctggcaataaaaccacagagaatagtttagccacaaccatattccctaccctcgaataaatctcactgtataacatgtttcttttctgtccttcagtaaaacatgatggtttcctccacaaatatcttctacgttggtgagatcctgcatactttttgatgatactacgaatggggatttactaaacggttatcattgatagacagaaatgctgtcagatttctaatacagacctcatatatagacagttccaatagtttattgactgaaaatcatattactctaagtaacatcagttttgtcttttcctatcatatactttaacacgacttttctttttaatggctaggacctccaaaataatgtgcaagagttgccaagaaggcaggcacccatatcttgttcccagcttttattatgaggttttgtttagtatttgagacagggtcttgctctgtcgcccaggctggagtacagtggcaagatctcacctcactgcaacctccacctctgaggctccagcaatcctccagcctcagcctcccaagtagctgggactacaggtgagcgccaccatgcacaactaattttgtgtgtgtgtgtgtgtgtgtgtgtgtgtgtgtgtgtgtgtgtgtgtgtgttttgttttgttttttttgtagagacagggtttcaccatgttacccaggctggtattaagaggttttactgttcccaaatgcctggtatttccacaatccttgatgaagagccttgtagatgcttgcttagtagacctttgtaaaccaatgtttctaagcctctctattctcatttctgcaaagtaagtagctaatacttataaatgtgattgcataattcttttttttttttttttgagatggtgttccgctcttgttgcccaggatagagtgcaatggcgtgatctcggctcactgcaacctctgcctcccaggttcaagcgattctcctgcctcagcctcctgagtaactgggataacaggcacccaccaccacgcccaggtaattttttgtatttttagtagagacaggatttcaccatgttggccaggatggtctcgaactcctgacctcaggtgatctgtccgtctctgcctcccaaagtgctgggattacaggtgttggccactgctcccagctgcataattctttagcccagttatttccctgtgtcagaccaacttttaagatagagctctacttggtttccagggaatatcactgctacaatatttttttcatgttacattttcagcatgccattgcacacaccatcttcattttatcctgacaaccacccagaaaggtactaagagcactccctaatgagaaaatcagaaatcaaaaatgctccaaaatccttaagtttttgagcactaacatgaagccacaagtgatctcttgtgatgagtcacatatattatttaaaatattgtataaaattaccttcaggctatgtgtataaggtatgtgatatggtttggctgtgtccccacccaaatctcatcttgaattgtaattcccataatccccatgtgtcatgggagggacccagtgggaggtaattgaatcatggaagtagttacctccatgatgttctggtgatagtaagttctcacaagatctgatggttttataaggagcttttcctcctctttgctctgcacttctcctcgaagcagccatgtgaaggacgtgtttgcttcccctccccaccttgattgtaagtttcctgaggcctccccagccatgctgaactgtgagtcaattaaactgctttcctttatacattacccagtctcgggtatgtcttcattagcagcatgagaacaaacaaactaatacagtatgtatgaaacataaatgaattttatgtttaggccaggcgtggtggcacgcctgtaatgtcagcactttgggaggccgaggtgggtggatcacctgagatcaggagttccagaccagcctaggcaacatggtgaaactccatctctacaaaaaatataaaaattagctgggcatggtggcacatgcctgctactcaggaggctgaggcaggagaatcgcttcaactcaggttgcagtgagccaagattacaccactgcactccagcctgagcgaaagagcgagacatcatctcaaaaaaatatatatctatgtgtttaggcttgggtcccatccccgagatatctcactatgtatatgcaaatattccaaattaaaaaataaaaaaaaacacttctggtcccaagatgaataaggaatactcaacccatactagtcttacttgatgtgtagaaaaacttggttacttggttaaagatatttatctgaccttggagcccagagcaaagactcaaacctgggtctcccagcacactctctcttccctatagccctcataagacaacgttgaatccaggagagtgtgtgttgacttagagaccccctcagagaacattatctgcaatgcaaactaagttcagattagtgcacaaagctagaggggaaaaaacatctgaaaaataagatgactactaaaaacctgacagaaggggacagcatccagggcacaggctctcaatcttggtactggtgacactgggggccagaaaagtatttgttgtgggagacgtcctgtgcattgcagggcaggtagaagcatacctggctagattccagtaatactctaacaccctcacacacgtaattaggacaaccaaaaacgtctccagactttgcccaacgtcccttggaggtcaaaactgtccctagctgagaaccactaatgtagagggtctgctctctgcctaggaaaatggttgcttcgaatttattgtaggggtatgggggtgctaaagaggagatgggtgaggagcagcaggaaggggaagagagggcggggaactcctgttgaaagataagctatacataccaagcaagcagaactatttcccttctttttcttttttttcagaactatttctaccccgagtgaggtcttctaggatgctactgtggtttttgaaagataacagtcagccgtattttcagtatctgacttcttttcagtaagttaataatacaataggaagagttgttaagaagctagaagaatcagctgggcacagtggctcacgcctgtaatcccagcactttgggaggccaaggcaggtggatcacctcaggtcaggagttcaagaccagcctggccaacatggcgaaaccccgtctctactaaaactataggtgggcgcctgtccagctactcaggaggttgaggcaggaagaagtgcttgaacccgggaggtggaggttgcggtgagccaagatcacaccactgcactccagcctgtgtaacagagcaagactctgtctcaaaaaaaaaaaagaagctggaagaatcaaatatgactgtacatctccctaaccagcaactcaaatcctctctgtctgatagtagccgaggtactgatcctccaaaattaagtttctcctggtgctcccctcccaaccccaccacctcctggctggggctggctgcccctaggaggatcccgaggactgcctggctgctctgtactcttttcagaagattttctcctttcctgaaacagcagcagttgctgagagctagatgcctggttaatctccttatcaatcagatattttccttatctgctgcttgtaagtgtttcctgttccataaaaataatctgataacaaatatggaacattttaaaaagggaaagcaaatcatttctgagatatgatttttctcccctacatgtataatgtgtgttaccagtttgataactagggaaacaggttgcaacctgtgttatcatggaatatttgcaggttattaagggatactgcagaagagaaaatgttcttatttccctgcttccataggctggctaacaagaaagtagaaaaggccctgtctatttgcttctggaataccttcaatgataccaggaaccggcaaacttttcctataaaggcttctataaggatagtaaatacttgaggctttgcaggccataaggcctctatcgcaaatactcaatttggccactgtagggcaaaagcacacacagacagtacataaatgaatgactgtagctgtgtgccaataaaactctataaacacaggcttcaggcagcatctagcccacaggctgtagttgcagacacctggtctacataaaccagagtatgggtgctctggctgtgtgtaaacacaaggtccatgtgtggacgatgaggaccatagactccagttcctacagaggccacacagggaccatacctgagtgaaaaaaaccatagcttcagctatcattctcctacatctggtaaaagcatgaatactgtgaagtatgtaagaaagaaccacctagccctggagtgtgaggatgcactggcattcaacctcgcagtgggggagacagcagggctgggcagagctcagacccatcttacagaggcagcccccactcagctccagtgatccaaggagttgggcagacacaaactcctagtgttgcctgaccttggggagaaactggcaatccctgcactcccctgaactatctcaactgttaatacactgtctcagcccaacaaaagacttctgtgggcctagtgcagtggttcacacctctaatcccaccaatttgggagaatgaggtgggagaacagcttgagcccaggagtccgcgaccagcctgggcagcaagaccctatctctacaaaaagttaaaaaaaaaaaattagccaggcatgttggggaacagctgtagacccagctacttgggaggctgaggtgggaggatcacttgagcccaggaggtcaaggctgtagtaagccacaatgacaccactgtactccagcctggacaacagagcaaagccctgcctcttttttttttttcttttttctgagacagagtctcgctctgtcacccaggctggagtgcagtggtgcgatattggttcactacaacctccgaggttgaagcgattctcatgtctcagcctcccgagcagctgggattacaggtgcgcaccaccatgcctggctaatttttctatttttagtagagatgaggtttcaccatgttgcccaggttggtctcgaactcctggcctcaggtgatctgcccaccttagcctcccaaagtgctaggattacaggcatgagccaccaggcctgggcctgcaaagccttgtttctttcaaaaaaaaaaaaaagcaagcaaaaaaagacttcaagtgtcccagtttttagggcaacatgtgggcccaagaaaataagtactagccactcattcatgatatgcagacaccctgtcctcagagaaggtgaagaggggccccatcatttctttgctatatttgatcaaagatgcacctaaggccattctgtacaaatctgctggcacgttatttctcaatcctttaatgcaagggaaaaaaaccaaaacacctcccaacaggatgtttgaactcaaatgtgtcagaactaaagagcagagtggtatttatctgtaaagaccctgacgtcatttggggcaaggcatttcttgccccatatactacaggacatccatttagcaacctgaccctcctccacaaaacgccgagagcatcttcccaggcattctcaaaccttcctaaggggtgaaaacactggaccaaaggtcttttaaaaatgcatggtaaaccttaggatgcttttaaaccctgaaaataaaatgtgttttaaagctctttaaacttttggctcggcgcagtggttcatgcctgtaatcccaacactttgggaggttgaagcaggagaatcacttcagcccaggagttcgagaccaaccagggcaagaaagaaagtgagacccccatctctataacaaaataaaaaaaactagccgggtgtgctgacatgtgccgatagtcccagctacttgggaggctgagggaagagaattgcttgagccggggaggtcgagcctgcagagccggggaggttgaggttgcagtaagctgtgatcatgtcactgcactccagcctgggcagcagagtgagaccctgtctcaaaaaataaaaatacaaataaaaataaacttccctaaaatgaattcctaatatatgataaatgggtggaatagggaccaaacttaaaactcatcccatattttcacatggtaataaaacatctctaccaaaaatggaaatatatggattatttgcctttttttttttttttgagacagagtctcactctgtcgctcaggctgcagtgtggtgacacgatctcagctcactgcaaccgctgcctcccgggttcaagagagtctcttgcctcaacctcccaagtagctgggattacagtcctgagcccagcctatttgctctttatgaggtgagaatagctttctttctggaacaatggaacaaagaagagaaactaaagtgaagaaaaagaagacgacagtggagaatcttcacatatgccaaagtcaaaagaacatggacatggaaagaaattcagaggtggatgaaatgagcagagcaggctgagtatgagacaacagggaatggtgggcagtgtggcaaacaagcaagcacaggcctgtgtctaaaggggcaggcttgactcagctccagctggttgctagattttgctgagtgctatggtctgaatgcttgtgtacctcccaaatttctatgttgatgttctaaccccaaggtgatggcattagagaagtggggccctgagaggtgatcagggccctgccctcatgaatgggattagtgcccttataaaaaaagggaccccggaacttggccaggcacggtggctcatgcctgtaataccagcactttgggaggccgaggtgggtggattacctgaggtgaggagtttgagaccagcctggccaacatggcgaaactccgtctctaccaaaactacaaaaaaaaaaaattagccgggtgtggtggtgcatgcctgtaatcccagctactcaggaggctgaagcaggagaatcgcttgaacccaggaggcagaggttgcagtgagctgagactacaccactgcactccagcctgggcaatgagagagaaactccgtctcaaaaaataaataaataaataaataaagggacaccggaaagcccaggtactcaggaggctgaggcagaaggataacttgagtgtccagcttgagcaatatagcaagaccccatctcttaaaaagagggtaggctgggcacagtggctcacgccagaggtcaggagttcaagaccagcctggccagcatggtgaaaccccatctgtactaaaaatacaaaacttagcagggcgtggtggcaggcgcctgtaattccagctacgtggaggctgagacacaagaatctcttgaacctgggaggcaaaggttgcagagagccaagattgcgccattgcactccaacctcagcaacaagagtgaaactccatctcaaataaataaggccaggcgcggtggctcacgcctgtaatcccatcactttgggaggctgagacaggtggatcacaaggtcaggagttcgagaccagcctggccaaaatggagaaatcccatctctactaaaaataaaaaaattaactgggcacagcggcgggcgcctgtaatcccagctactcgggaggctgaggcagaagaatcccttgaacctgagaggtggaggttgcaatgagccgagatcacaccaatgcaccccagcctgggtgacagagtcagactctgtctcaaaaaaaaaaaaaaaattgaaaaactcagttcctcagtcacttgccattttcaagtactgaagaaccacatgtgacctgtggctaccatcttggacgtgaggttttttttttttttttggagacagagtcttgctctgtcgcccaggctggagtgcaattatatgatctcagctcactgcaacctccgcctcccaggttcaagcaattctcgtgcctcagcctcccgagtagctgggattacaggcatgtgccaccacgcccggctaattttttgtatttttagtagggccagggtttttgccacattggccaggctggtctcgaactcctgacctcaggcgatccgtttgcctcggcctcccaaaacgctgggattacaggcatgagccaccgcgcctggccagacatgagcatttttacaggaattgtttatttcatataaagattgtatgattattctacttagcagagaaactgactttatgtttcatttttaatatcactatttatggcatttagctcaatgttcacaaccctgtgaaatttgtggtagtatcattatccccatttcagtagatgagaaaactaggcacaaaagaggttaacttgcccacagccacggagcaaaagcagggctggcatttcactatgtaattttgagagtgaaaatagattcatgctcagaaacacacacctctcacaggcctgggtatttaaccgttgctaggtctccttccatgaaagcaacaatctcgtttaattcaactttccatccccagggcccactcctctactcaataatgcacaaagtggatgaatgcatccctaggaatcactgctgaagaacaagtggcatcagaaccaacgggacactgtttccttcagtgctatgagatccgacctcatagtccagggggatagatacaatccaccagtaagtccactaaagtgcctctccatttttgtaatctgaagagtatctagcctgccccagagaattctaaagctagaatgtcccttagaaaagatccaaacggtgaacggatttttcctatctagctgactggtgctagctgccaagggagggtgggctctggaaagaatcctctgtgcttccacgaaaaggaactgtgaccaattacctaagcctgcccctggcaatgcctcttaccaaagaacctaaacccttcatttttttttttttctgagatagagtctcgctctgtcaccaggctggagtgcagtggcgcgatctcggctcactgcaacctccgcctcccgggttcaagcgattctcctgcctcggcctcccgagtagctgggactacaggcgcatgccaccatgctcagctaactttttttgtatttttagtaaaggcggggtttcaccaggttggccaggatggtctcaatctcttgacctcgtgatcgacctgcctcggcctcccaaagtgctggggttacaggcatgagtcaccaggcccagcctctaaacccttcattttacagatgagaaaactgaggccagaagggaacttgcctcaagccaagcaaccgcttccagacagagctgagaactagtcctgtgggcatggcccaggaggggaaaactcctcaggccacatggggaaaacagtcctaaaagcatgaaaaaaaaaaaaatacaaatacaaggaaacgccccaaaccctaaagaattatataccctcatctcatctgggtccctgctctgtccccgaaacagatctgaaaacccactggaaatttctacacaggcccatttttagccatctttttttgtccaaggcaaatgacagccagcgcaaggcagctaactaaatccaagaaagccggcgcttacaaggatccagaggttcagcgctactagctggcctctgtcccaccagtgaggacaccgttcccagcggctgctttacctgctccttattgttactgttcagtaagccaggtttctttttctttttaatggggcttgttgatgtgtcctgcggcgagtggccattggaagaatgtggagggctggggaactttcttttctgggctgttctctctgcagagccaggatctgaaagagatacaggaccacaggttttaaagcagtcagggaggcctgggccccacagggaggaggtgtggaggaaccaagtgtgggaacagagtgcattctgtcccccaactcccgaagccacttcagtgttcctcctcccagaatatacgtgcccccttcttcactgtctgcttcaacagtcagacaagtatttctttgacctatgtaacatttttgtaaaatcttaacttgttgccaagatacaaaaatcaggaaatttcatgtaataacctagatttttcacttttcttaaaaaaacagattaggagggccaggcacggtggctcatgcctgtaatcccagcactttgggaggccaaagtgggcagatcacaaggtcaagagttcaagaccagcctggccaataccgtctctactaagagtacaaaaattagcctggtgtggtggcacatgcctttaatcccagctactcgggaggctgaggcaggagaactgcttgaacccaggaggcggagatttcagtgagccgagattgtgtcactgcactccagcctgggggacagggcaagcctccgacgtgaaaaaaaaaaaaaaaaaaaaacagattaggacctgcaggcccctatagcaccagatacagctgagtaacagctaccccacttttagatggaaacatgtgcaatcgccactcttccccactacgtccctgctgatgagaccgaggccaacctgccaacagtcatcacacagggaccagtattgttcttaccccaaagaaatacgacttgtccatgcccatgcctgattgcaaaagcaggaaaccaaagaagatagaccaggaaggccatacttcaaggaaatgaaggcatacattctcctttgtggaaaacaacatcatttattcgtgtttaataggctatgaactgtaattgtgtggaaagaacacaccccacccaccgggaagttcccgtgctcccaccgcctctgggcctcgtgtttgagaccctcctccaaaaagatcaatacaaattacatccttgtggattctcaccagccccactcttgttcatgcaccccttcttttcatctttcagcatctcatttaaacacatgtacacttcagccaggcacggtggctcacacctataaaccccagcaccttgggaggccgaggcaggcggatcacctgaggtcacaagatcaagaccagcctggccaacatggtaaaaccatgttaacgagatcaagaccagctgggccaacatggtaaaaccagtcctctgtttgcagacgtctgtttcaagtgctttgggtacagcccacagtgctgcaatgcagtcatcttgcctttgctccttttccactgtatttgtagaatgtgtttctagaggagattgttgggtcaaaggccaagtggagaaaaagttttcacgaacaatggcgggaggtcatgagatcaagaccagcctggccaataaggtaaaaccccgtctctactaaaaatacaaaaacaattagctgggtgtggtggcacacacctgtaatcccagctacttgggagactgaggcaggagaatcgcttgaacccaggaggcagaggttgtagtgagccgagatcacaccactgcactcaagcctgggtgacaaaagtgagactctgtctcaaaaataataataaaaatacataaacacaggtacacttccactaccatccattcaatcttcacctccaaggacttgaatccactccatgcccaatggtggtcttcttaacttagggacgatgtaatgacacagcctggtgtacctgacatcctgaggaacgaaagctacaaataccacaagaggggtgagctgtgccaagaccataggggggatggggtgggatgggatgtgaaatctgcgaagatgtcaattaccaaagatgctcctgccccagttttaccactcagcatgtaggctgcatggtgcatctgtctccctgtctgtaggagggtcactgacagcagattaacagcatccaacgtggtccacgcaaggcctcctagtggttgactttcatgaaaaggcaaagtatcttccagcagattcacaaaggaagacaatgaacactttcccaaaacccaatctacaggatggaactctccagcctcaccatgcaagcttctggacaatcctgaacaaatattcagggggctgcgtggagacccagtcatgagtggaaattaaatgctaacaacaggtaccttgagggtgaacagacctgagagtccagagatcaaaccacagacatcaaaagggcggcccagagagcccaaagcgctggaccaaaggcacacagcagctagttagtgggaaaactcacgaaagagacaaagaggtcagcctagccaacatggtgaaaccccgtacttttgtactaaaaacacaaaaattagctaggcatggtagcgcacacccgtaatcccagctacttgggaggctggggcaggataatcacttgaaccctggagtcagaggttgctgtgagccgagatcacaccgctgcactccagtctgggcgacagagcgagactccgtctcaaaaaaaaaaaaaaaaaagagagagaggtgcagcccggggtgagcacattcccccagagaaacctcccctccctcccacatgggtcctcacccgactctcgccactgttcctgaaaactttttctccacttggcctttgacccaacaatctcctctagaaacacattctacaaacatagtggaaaaggagcaaaggcaagatgactgcactgcagcactgtgggctgtacccaaagcacttgaaacaaacgtctgcaaacagaggactgctctaagaatacattacagtcacatggccggacacagtgttcacacctgtaatcccagcactttgagaggccgagggggaaggattgcttgagcccaggagtttgagggtattgtgaactatgatcacgtcggagcctgggtgaaaaggagagacactgtctctgaaaaaaaaaaaaaaaaatttaattataaaaatttttaagttctttaaaaagatctaaaaacacctgggcaacatggtgaaaccccgcatctacaaaaaatataaaaattaggctggaggccgggcgcagtggctcacgcctgtaatcccagcactttgggaggccaaggcgggcggattacaaagtcaggagatcgagaccatcctggctaacatggtgaaaccccgtctctaccaaaaatacaaaaaattagccgggcgtggtggcgggcgcctgtagtcccagctactcgggaggctgaggcaggagaatggcgtgaacctgggaggcggagcttgcagtgagccaagatcgcaccactgcactccaacctgggcaacagaggggtgagactccatctcaaaaaaataataataataataattaggctggggacggtggctcacacctgtaatctcagcactttgggaggccgaggcaagcgaatcatctgaggtcaggagttcgagaccagactggccaacatggtgaaacctcatctctactaaaaatacaaaaaactagctgggtgtggtggcacgtgcctatagtcccagctacttgggaggctgaggcaggagaatcgattgagcccaggaggcaggggttgcagtgagctgagatcgcacgactgcactccagcctgggcaacagagcaagactccgtctcaaaaaaattaataataaataaagtgtatctagcaccattaatggaccaatattcctcccaaaaaaagatttaatatacacatcaatgtttgcataaacctagaatattcctggatgaacacaaaagtacaacaaagctcgacttggggactactggttgccttgggaggggtgcctgcagggagtccagggaaggggagtccagggaaggattattttccactctatacccttgtgtacttatttatcatgtgactggatgacgttacgaaaataaagaaaattggccaggtgcggtggctcacgcctgtaatcccagcaccttgggaggctgaggttagcagatcgcttgaggtcaggagttcgagaccagactggccaagatggtaaaatcctgtctctactaaaaatacaaaaatcagccaggtgtggtggtacgctccagtagtcccaactactagggaggctgaagcgggagaatcacttggcgccaggaggcagaggttgcagtgagccaagattgcaccactgcactccagcctgggcgaaagagagagactccatctttaaaaacaaaacaaaacaaaaagaatgcaaattatcaggccccaccccagatctacagaatcagaaactctggggtagggcccagcaatctgttttaataagtcctcccgaagactgggaggtacactagtttgaggaacgctagggtatgtgtatgtgtttaggagatggggtctgagttctcaactctacacaatcctgttccacactggcgagccagagccaatggcctctacttccagacattatttgaggggttggttcaggactcaggatagaagctaagcaagggagtcaggctggagaatgaggctaaacaggaaacaaccccaggcaagtctccacctctcagggcctcagggcctcacctgcaaaatgggaagagccgggagaaagggactagactagaagttcttgtttaaagaccagacagtgctccagggacccttgaacaggccatcactgtatacaggagtgcaatttctagggacatggagtcatagcttccttcacctttgcaaaggtgtcctcagctccaatgattaaaaacttcagggcccccagaggatgttaaaagtccctcttcaacattacttaatttaatgagaaagtgggaaaaaaaatcactagacagtaatatacttgtaagcgatttagagttggcaagggactatcacccaagcccaccaggaaacaaagggggaaactgaggttctgctcagcaagaggtagggggaggtgggtcctagcccaagcatgcccacacctgagagtattccaaaccttctagtttcagcaaaacataaaaaccccaattctgtttgctgttacaaacaccaattccccctggagttgatgagagttcagtgactgtatccaaggggtcgaaatttgataggttccaaacaacagacacatcagtcaacagcaggagatttcaatgaagggttgtagggagaagaattaggaaatgcctgctggattcggtatccttcggagggatgagacagcaggggggcattattacttaaatgccccccactccagtgggggctgggcctctggtgatgatggactggtgggtgtacacctgactgtagccgtggtacccaggctccataaggaccctttccagaaagctgagtcaattttttcttctttaatgatttaattctgacaaggatgtattgcccagtgcatttcatctataaactttgaacaatgacaaacagccactgtcgactgaaccactggttcaccctggatctgaaagacttttctgctgccttttctgagggagtaggacctgtgaccccgcccggctggctcactcacaaccctctgcctctcacccatcccccaaaaatgagtggttctgaatgagttaacgtgggtgagggaggaatgcagccttatggagaggacagagcagtgactcaggaaaacagcttggcatggagcggaaagcagcagaattttcctctccttgtgacattttgctgaaattgtaacaatatgggaaggtctactgggtattaagaaccaggcatgaggccgggcacggtggctcacgcctgtaatcccagcactttgggaggccaaggtgggcagatcacaaggtcaggagttcgagaccagcctgaccaacatggtgaaaccccgtctctactaaaaatacaaaaattagctgaatgtgatggtgagcacctataatcccagctactcaggaggctgaggcaggaaaattgcttgaacccaggaggcggaggttgcagtaagccgagatcatgccattgtactccagcctgggcaacagaacgagactttgtctcaaaaaaaaaaaaaaaaggaaccaagcatatgaggagatccttcccaagcctgtgatccaccagaaatcatcctggagctcagcacttcctggatgtcttttgatttaaggggcatcttaattcaagataacacaggctcatagctttcctgagccaagagtatgaagagctaagagtttcggccaggtgtggtggctcacacccataatcccagcactttgggaggccgaggcaggcagattgcctgaggtcaggagttcaaaaccagtctggccaacatggtgaaaccccatctctactaaaaatacaaaaaaattagccaggagtggtggtgtgcgcctgtaatcccagctacttgggaggctgaggcaggaaaattgcttgaaccagggaggtggaggttgtggtgagccaagatcgcaccactgcactccagcctgggtgacagagcaagactcgctctcaaaaaaaaaaaaaaagaaagaaagctaagagtttcttttattatatgtgatattctaggcaatgttcaaaatgcatttcctgtagtccccactaagtcacctgcctgagatcacaaagctaccaaggagcagtgctgggatttgaacccaggcagtgaggctccgagggccagagcagtactgggatttcaacccaggcagtgggactccgagggccagcttctaatctctgtaccacatggccttgtaccaggagggcctcatcctcagccctgtagcaagaggactccctaatttagggtctatgatttaagagcacactctcattttgccttttttcccctaaactgcagatggaagtatagggacagagaaggtccaacaaacagtttcaggaactgggaaaaggtggaaagtcgtgtcattcactgatgacaccgttctctcaaaggcagtccccagaaagcacattcacctcccaatttccaaacagtggcatcagtccctgaaataggctgggggctccagggccaactcacctccccttttccagcctccatcaaggctaggcctccccagcaggccacatcaggtacccgccctccaccccactcctgcccccacatccggtgcctgagtcacagcacatgccgttctccaggggctaggaaatgacacaccattacagggaattgtctcctccctcaagggaaagggccgcagctgaaaggccgggagcttcttgtgtttttgtgggtgtttaatttccttaatgatgtcgacagcaagcctgctggggcctgaacgaaaagagaagcttggtccacaggctgagacaggcatgacaggccacaggagtagggcaaccaaccatgtgcttagctgggtcccgggcaaaccaggacacataggtcaaggcatatgctctcatgggccaggttgcaaacgacagagaggcaggatgccacagtggtggggaatcagctttctggcgtcaaaatgcatgcagaacctggctgtgctctcccctgcagtgtgaccgtaaaaaggcaacttaacctctctgtgcctcagagagtttaccactttacaagtggtaccttgtaaagttatcgaagaagtcaatgagttaattcacgtaaagctcttagtataatacctggcaaatagtaagcacctattcaatggtaactaatgggtaactgtattttttttaaccaatcactcttcctccttttcttgcttctcttccacctcctccccgactaccgccccccactccaaaaacacagcttgctttctggaaggagcatgttaaatcaattccacaagttcaaagctatggaaaacaccggcctgtgtagactggagaccagaatcagcccaggacaggatttctgcatttcaatcagactgaaaatgccaggtttcccccagtaactgtgaaggcagggtcagaagcagaggcctgctctacagcccttttcgtaatcaccagtcctccccttggcctacttcaaacatgaccacacactgctgctcccccagaagcagcaaagcagagcatggttaatcacttcaaagcgtttcccaaagacacagagcaggtacccaaacaggcctcccttccccaggaatatttggggccctccccaaccagtaattacatcataaagagacaaaagtccggaatttcctcctggcagagcatagaagtaagaaatcaggagcaaaggttgggggtggggaggaagcaaaattgtcctcgcagcagagaatgcctaagccaggaggaacttgtaaatgaaaaccgctcgcattagcaaatgattatttcctccaacgctgaccgtctcttagacccacagaaactcgaggaccggtctgcaccctggctgacttgggcctgccagagctgccgggctgagccctctcctccagaggactgcactggcctgaactgtgcttataaagaatctctgcaaatcaacaggaacttctcatccagagccgggatagggagggctggaatggaaatgaggctgtggaatgaaaggtcactctcaacttggggaaaatggcatttcaccaggaacatcaagtacctcggaggcagaacatgcgaggggcagggaacgccaagaggaggcacttacctgccattgagaaagtgcggctgctcagagggcctagcctctcttgttcaaaagagaacagaggctcacccacagcagacattcctgcttccggatcctcagcggcctctcccagggggaggaggaagaagcaaagagaacaggctaagagtcaccacttaccaggccagccccggtcttgtacgcattaggtcgcccggcggggcaaggacactgtcacctctttgcaatcaggcagtctgaaacccagcgacttgccttcatgtccccgggctttcgcctataatttatcaccctcaacagcagctcggctgagctgaaagtctccggtgcagtgcaccgaagagccattgatttcgtgggattgtgaataaatacgaggaactgcagttgttctgctggccgaggtgacaatatcagaagggagcctggggggagggaaacagctgtggtttgcattttgaagttgtttttaacatttttagtaattgtttcagattctccagttctgatgcccctctcctagaaatgagaaaacccatcttttatacttgaggtataatcctttcccactagacacagcctcctccacccttctctcaataatgcagaagtggtgattaaagggcacattcatatgtaaaaggcgaacttccaaactcgcctggcaggacagaaattgcttcaatctacagaaaagaggctgatttacaattgaattcagtgtttagccctcaacaactagaggcaatagcaaccgcggccctttctcctccccagctgggatgaggccctctggaaaaacgacaacatcgcaacaggaatttcctggatcaagaatgccaagttctttccaattttactgaggcaggatccgactccctgtgagaacgcactgcccaccacccacccaccccctcagcaggcccaggccccaaaggctccctccaacatgtgtacatgaggcccttcaaactcgaccggaacaccacaaagaatgtggagaaaccggttgcctctggcctttacattgtggctggctgaggagctggttctggtggctgacacccgttggcactatttatccagcccctgcctggcttgggttctggaaatctccggtggtagtggcttccaaactgcaatggggaatcgcggcgtcagagggcaattcagaaacaaaaagacagttctgtgctggcagcatttgaagcacagaagtgggttgggagaagcaaagggaaattagcttcagaaagggggcagatgaaggaagaggcgccactgctaaccaaccaaggtccccatctgccctggatggtatctctaaaagccacctaaagaaggcaaaattctctactgaaacgccaggtacgaagggacaggccctccacagtcaccttgtcacattcctttggggagcgaagagttcagacccaacatgtcacccaaattaccctggccagccaccacgtaaagatgctgcggctgtgcatggtggctcacgcctgtaatcccaacacgttgggaggccaaggcgggcggatcacctgaggtcaggagttcgagaccagcctggccaacatggcgaaatcctgtctctattaaaaatacaaaaattagccgggtgtggtggcacacacctgtggtaccagctactcctactggggaagctgaggcaggagaatcgcttgaccccaggaggctggagtgcagtgagtcgagatcacgccattgcactccagccggggtgacagagcaagatgccatctcaaaaataaataaataaagatgcttaacatcactcagatagtagtggggtgattctaagaacatgtcctattgtctacagggctcatgggtgcacagaaggatagacggggtagccactgcaacagggctttgtagaaaagtcagacaggaaccaacattgatgcccatatgtgaaacatcatgatgcagccataaaatggaataaagatggaatcccgtctgcatagacgggcatggtccaaaatccaagtgaaaggagaccagaaatagaaccagggtaaaagtttgttctctgaggcttctgggtttgcagagacatggaggaacacccaggaaacccagtaaacgctggactcctctgaattatttctgatcatgtttacatatttaacgaaggtatttattaatggctttggggaaactgggtgataatgacaatatttatggaacactcactgcatcctgggcactgcccagccagggatcacgtctgtatcccttgtacccggcatacagcaggagctcagtacacgcccccatcatcaaacaaacacttttacggggctcaggtgtttagaagagtggaaagcagtatcagcacacccaggggacatctggcaatgtctggggacatttttggttgtcacaactgggcaggaaaaggagttgcgacaggcatctactgggtagaggtgagggatgttgctaaacattctacaatgcacaggacagccctaagacaaagaatgatcaggcccaaagtccacagtgccaaggctgagaaatcctggtagaaagaaacttcagtgagctaccaggcaggtctcaccatgtgtaaacacaccacccacagaggtgcatgtattcattaagaaggaaaatgattcctgatgtttcacctggtggccctgacttcagacttcaaagaaaataatgggaccagtcagtcaacaaatagtcactaggcaacaactagatatctgggctatcaggaaaactgtcccaggaaggcctctgccctgatggaaggacagctagaaacacagttgtaacagctaccttttattgagcagttactatctgggaggcattgttagaaatacaaatatcgatttatttaaaactcgccgcccttttttttttttttttttttttgaaacagagtctcactctgtcacctaggctggagtgcagtggcacaatctgggctcattgcaacctcagcctcccaggctcaggagatcctcctgtctcagcctcccaagtagctaggactacaggcacaggccaccatgcctggctaatttttgtattttttgtagagaaggggtctcgccatgttgcccagactggtctcaaactccagggctcaagcaatccctctgcctcagccgcccaaagtgctgggattacagatgtgacccacctcacccagcctccctgtttcattgataaggtaatgaaagcccagagaaaaccaggcccatggtaaagcggctattaagtacagaatgattgagaaactgattacagatggacaaaccactgaacaggaaaaatatcaggagtttgtgaacacacctagcaggtgtgaggatagacagggaaatattcctctatttcctttgcagaagggtttcatgtggttcacagctattgtttactgagaagctacaaactgtcccaagaatcccaagaggttgggatggcatttcttttttttttttttttttttcagcacagaatctcactctgtctccaggctggagtgcagtggcgcgatcttggctcactgcgacctccgcctcctgggttcaagtgattcccctgcctcagtctcccaagtagctgggactacaggcacgtaccaccacacccattttcactatgttggccaggatggtctcgatctcctgacctcgtgatccacctgcctcggcctcccaaagtgctgggattacaggcgtgagccaccacacccagccaggatggtatttctgtacccattttataggtgaggctcagagaggcaaagtcatttatatgcttcaagacaagcagatcgacacagcacgccccacctccatcacggttgagttccactctaaagcccttcactgtacaggtcaactgtctctcctaggcttgtgagtgccacctggtaattctccatcacaaagggcatgcttggcattggccaacgtcaacacagcattgtcgttcagtgtgtgggctctggagccagactactaggtctgaatccaggtgctggcacctgccagctgtgtgaccttgggcaagtttcttagcctctctgtgactcagtcattcagttggaactattaggctcttcccaaaagggttgtgaggattaaataagataatgcatacaaagtgaatgaaaggcatctggcacatcaaagcaccatactttattaccattattctcctggggggaagagggggccagggcacagaaaaaggcaataaccgagaaatttcaaactcatttcccccaacttttctcttttttgggggagacagggactcactctgtcagccaggctgcaggacagtggcacagtcatggctcactgcagcctcaacctcccaggttcaagcgatcctcccacctcaggctcccaagtagctaacaccacggtgtgcaataccatgaccacttaattttttatttttcgtagcgatgggatctcctagtctcaaacttctggggtcaagtgatcctcccacctcagcctctcaaagtactaggactacaggcatgagctgttgcacctggcccccaaatctttctgtaccttcaccagactacctcttccaagcctgtttttaaaaagggttcactgatgagaaacacaaatattcacaataaaccccctcaggctgtcaggagctcaaggaagccaggctcaaaatccctccagggctcagaacttccttgaaaatcaaagcagaattctccagatggcccacaatcccagccccaccccacctccactgaccttcccccaggactcctccaactgcactcccctctccactcaaatgaggctcatcaagctagggagagagctggtcctggctcacatggctgtgtgtcccaacaggttacttcacctctctgagcctcagagtcctagtcatctgccaagtgttattaagaatgccaaacctggccgggcgtggtggctcacgcctgtaatcccagcactttgggaggccgaggctgatggatcacaaagtcaagagatcgagaccatcctggccaacatggtgaaaacctgtctccactacaaatacaaaaattagctgggtgtggtggtggaggacgcctgtaatcccagctgctcggggggctaaggcaggagaatcacttgaacccgggaggcggaggttgccataagccgagatcatgccattgcactccaacctgggcgccagagcgagactctgtctcaaaaaaaaaaaaaaaaaaagaatgccaaacctttaccggtcgtggtgtctcacgtctgtaatcccagcactttgggaggccaaggcaggtggatcacctgaagtcaggagttcgagaccagccaggccaacatggtaaaaccccatctctactaaaaaatacaaaaaattagccaggcatggtggcgggtgcctgtaatcccacctactcgggaggctgaggcaggagaatcgcttgaacctgggaggcggaggctgtagtgagccgagatcgagccactgcactccagcctgggcaacaagaagctctgtctcaaaaaataaaaaagtaaataaaaacctcaataagatagtgcactccctgcttaaaaccctcaaagagcttactgtagacacctaaggtcttatgaagacctgcagtgcccctggtgacctgatcctgcccaccttctctccttcattcactcagctccaaccccaatggcctcctttcagctccttagacaagctccttcgcatgcggctggccccttcatctataatgttctgtgcccagtcctctccatagctgccacttcatcttttggctcactgccctagagaggccttctctgaccaccccagcctccagcctccagactccttattatataatcctgaagttatttttttcccttcattacagtcatatataggtgaaaattattttttattttttattttttgaggagtctcgctctgttgcccaagctggagtacaatggtgtgaccttggctcactgcaacttccacctcctgggttcaagccattctcctgcctcagcctctcgagtagctgggactacaggcgtgcgccaccacgcccagctaatttttgtatttttggtagagacggggtttcaccatgtttgccaggctgctctcaaactcctgacctcaggtgattcacccacctcggcctcccaaagtactgcaattacaagcgtgagccaccacacctggcccatagttgaaaattatcaaaaattattttcctcttctgctggttcactggtttattgtgtctctccctccagagtgtgagctcaatctcagcttgtccatccttctttgctgtagcccagtgccaggtacatggcctggctcggaagtaccccaaagtacatatcagaccgactaactgagcgactgtacagggttaacaaagccctgtacaggtgggccagccaacctgactcagcaaactccagtttttcttccccagtctaagaatttcttccagcaaatcaggaaggcagcagggtagcgaagtcaacagggaagattacacaaatgggagcctggtcacgtcggcctctgaaagggaccccagaacaggacattctcctttcaacaggtactcagccattctcttgcctaaagaacccatttcccccaaaagcaggggagtaagtaaagatttataacttgaatgggatggggccattcagctaaatgcaattactgaaaaatcaaagggggatatctcaggaggtttttctaagacaaccaatttactcattctctcaattattctttttccattttgttttgttttttttttctgagacagagtttcgttcttgttgcccaggctggagtgcaatggcacaatctccacctcctgattcaagcaattctcctgcctcagcctcctgagtaactgggattacaggcacatgccaccacacccagctaattttattttattttatttatttatctatttatttttttgagatggagtattgcatgtggctcaggctggagtgcaatggtgcagtctcagctcactgaaacctctgcctcccaagttcaagcaattctcctgcctcagcctcttgagtagctgggattacaggtgcccgctaccacgcccggctaattctttgtatttcttagtagagacagggtttcaccatgttggccaggctggtcttgaactcctgacctcgtgatccgcctgcctcggcctcccaaagtgatgggattacaggcatgagccaccacatccagcccaccagctagtttttgtattttttagtagagatggggtttcaccacgttgcccaggctggtctcgaactcctgacctcaggtgatccacccgcctcggcctcccaaagagctgggattccaggcgtgagccaccatgcccggcctcccagttattcttgaggagagctattgtttcagaattatttagcagttcaaaaaataaaaataaaagaggcatgactttctccagggaaaacatattcccttctaggagacccgccactgagatggccatttaaccaaatcttcagtcttggttctgggccctttttcttatacgtctgagtctgaggatctctttttccaaaacctccgtagatcctcagtctccctctgggttctccaagtctgcccctgctatgagaagcagggatcagatacaggtactgatctatgtgcagacaggctcagcttcgactgggaaaagcaaaaaattatttttcaagttcatcttccctgcatcccatggaaatgagtcaagagatattcagtctgctccttcctgtctccatctagttccctcgagcttctcagagtgtcagcatcacaccaggcataagacgggtctagattttcaagataaatatttgtcttacaacacagtccctcggctcttatcaactgctactgtatctggtcccaagtcaagaaatagcaacctggtttgaagtgactgtacccaaacttgaagtctggggatggggagttacgggagggtcattaaggaggtggtgcgcaaaaccaggtcagccttattaggaagagagcactacttacagctgatgcggtgaaccagtgatctggaaaaggagcaatcagtggccaggaaaccagtcagcctccctagtagctggaattacaggcatgcaccaccacgcctggctaattttgtatttttagtagagatggggtttcaccatgttggccaggctggtctccaactcccgaccgcccacctcagcctcccaaagtgctgggattacagacgtgagccaccgcctttaaagagaagctctagcttctcttttaaaataaggtcattcacagatgaaacaaggggttaaagaaaaaataggccaggtgcggtggctcacacctgtaatcccagcactttgggaggccaaggcaggcagatcgtttgaagtcaggggtttcagagcagcctggccaacatgatgaaaccctgcctctactaaaaatacaaaaatattagccaggcgtggtggcacacacctgtagttccagctacttgggaggctgaggcaggagaattgcttgaacccaggaggcaaagattgcactgagcagagtttgtgccactgcacttcagcctgcgcggcagagtaagactcaaaaaggaaagaaaagaaaatcacaagatccctccacatagggccccctattcccacatggaacaatcctcccgcctgcccactttgggtagaactccagaatccctgtttgccgaggtctccattattcttaactttcagataattaaatctataacttattgtttttttgtttgtttttccagaaacaggtcttgctccgtcgcccagcctggagtgcagtggtgcaatcacagctcactgcagccttgacctcctgggctcaagtgatcctccggcctcagcctcccacgtagctgaggctacaggtgcatgccaccaagctcagcaatttttttttatttcagagatgaggtctcactatgttgcccaggctggtcttgaactcccgggctccagtaagtctcctgccttggcctcccaaaatgctgggactacaggcatgagctaccatgactaccctagatcattaaatctaaacttgaaaggcccttaaagggtgtaacaggacaggggaagcagagaaggataataaggtaaagagagggatcagagacaagggatgttttgctaggatggccaggtcctagaaagttcaaccccattataggtattgcataagttttttgacatttttataagcatggagagggtggtatagacaaaaacataccaaactgttatcactggttacctggcaggagaagatttttagctttttctttgtatactttggcttgttgtcaaggagatacactgatttttatcatttgaaaggaaaatccaataaaccttaacccctctgccaccccacaaaaagttaattcttttttttttcgagacagagtctgttgtccaagctggagtgcagtggcatgatctcagctcactacaacctctgcctcccaggttcaagcgattctcctgcctcagcctcccgagtagctgggattacaggcgcgtgccaccacacccagctaatttttgtatttttagtagagacagggtttcaccatcttggccaggctggtcttgaactcctgacctcaggtaatgcactggcctcccaaagtgctgggattccaggcatgagccaccgtgcctggccaagttagtttccagttcttggaagagatccttcattcacaaaacatttaatgggcaactaccatgaaatgccagtcccttgttagtctaaagaggtgagagttatttggtctatcagtctagaagagacacacaggtaaatgcataattacggtaaagcatgttgaaggctggagggaggaccgcccagctccctggcatatcctgtggaactttaccccagtcaggcctaggtgccaaggggcctggcaaaaagggaattcagcagggcctgaacaaaacacaccaacttgcaaagatagaaagaggactgtgttctctgcacaacttttcaaagaataggcaagctcaggaggcaatgaccaagcaaaacttaaaactcaataatcatgcatggaacatgttcagtgctgtgtcccctggcgacatagcttcacctacagcattcagcacagcatgcacaacaaatccattaatctactaaggctacggaacagtgtgatccaatcaagcttgctcgaatgatggcaatgttctcgatctgttctctatcagtgctgtctaataacagcagcctctaatcacctgtggctgtcagacacttgacacgtggccagggcagctgaggaatgaattttattttgtaaatctaatttttttttttggagatggagttttgctcttattgcccaggctggagtgcaatggcgtgatctcagctcaccgcaacctcctcctcccgagttcaagcgattctccagcctcatcctcctgagtagctgggattacaggcatgcaccaccatgcctggctaattctgtatttttagtagaggcggggtttctccatgttggtcaggctggtctcaaactcccaacctcaggtgatccacccaccttgccctcccaaagtgctgggattacaggcgtgagccaccacgcctggcttgttaatgtaaatttaaagagccacgtacagctagtggcgactgtgttggacagcacagctgcagaagcttaatattaagacaaagaagcatgcctggcaagcaagcaggacactgcacaatcatccacccatcccaatttgcctctagggactgagtagttgaattcaaggcaccggatgcagggaaatgtgaatatggattcacctttcactcctttagtctagcctggcaattgttaactctttagtatgcatacgaatttctgatcaaagctgaatactttcgtgggcaatttaaggtactttgaagagtgatttttgactttggaacctaaaagaacttctctgtgggagactgtaaataaagggttcaggccaagagagggcttgggtctccatggacacagtgaggatggtcctcacgaaggtcagtctggaaggcaatgccaagtgtgtctcagcaaggtgcacatcacaggactctcacaaggccgtgcagtctgtccaggaaagacagatgctgcaggacccctgcagtgcagtggcaagatcatagctcactgcaggctccaccttctgggctcaagatatcctcccacctcagcctcccaagtagctgggtctgcagagacaagccaccatgcctgggttttttgcttttttttttttttttttttgtaggaacgggtgggtcttgccactttgcccaggctggtcttgaactcctgggcttaagctatcctcctgcctcagcctcccaaaatgctgggattacaggcgtgagacaccatgcccttaaggctgtgttcttaaggagccactgcaaatttaaaggagagtgggacaatctgacttgtgttttagaaggcgcccattagaagttatactaatatgtcagaaagcaaagaaaccagggggaaagggccatttcaaagagtactatgtccctagagggaaaaggaagacaggccaccagtcgctttgcagagaacagacacttgagctgggtaataatctccaggcactggattaatgctgaaaacaaagccatcctctctcgccgaaaggctgcttttacttcagtctctaggatagaagttctacccatctgatagagctaaatcatttgttcattcaaaaaaatatttattatacgctcaccagcagcaggcaaggtggtagtaaaacaggatgagcaaaaacaaaaggcagaactcatcctcattttgagccttaaaattgatggggagtaaggagaggaaggcaaggaggggaccttcaaggtatgggcaaaggccctgaggctttgatggatctgcacagtcagtgtggctggagaagagagaagtggaacacggagagaagtggaacacagagagaacggaacacggagagaatggaacacagagagaacagagactagcaagatgggcagaggccagcacaggagggttttgcaattatgaatctaaaagccaaggaggaaacacttaagagtttaaagtaggaagggatagccaggaagatgttcctttcaaaagactgggagggtgcggcagatagagatagtgagaacaactacgaggccactgtagttcaatggtgataggctggttgaagtggagtgacatttaggatacgatattgtaagaaaatgacacaaaagggcaaagaacagaagaatggggaatgagtccatatctctgggggtgaagatgtaaaatctctcatggacatcttgagtttgagacgcccatgaacaggcagggaggtcaggtaggcagctgaccctctgcaccatgactcagaagcaatctaggttggaaacataaatgtctgagtcataaagctccagatgtgggtaagatcacccagagaaggaacgtgctaggcgagacaaggacagggccaagctttcagcaactccagcatttaatggccagagagaggaggagaaggtgccagggaaacagaaggaaaatcagcactgcggtggcaaagaaggcaaaggaagagagagtgtccacaagaataatcagcatctccagtactgcagagacagcgcagcagatgaggatggaaaacctcccctggaaaaggcaacacagagtctccaggaagctcagtggggatgtgaatgtggaaggtcagggtggaagccacattggagcttgcaggacaaagacaggaatacagacgcttctaagaagtttggcttgctggacgcggtggctcacgcctgtaatcccagcactttggaaggctgaggcaggcagatcatgaggtcaggagttcaagaccagcctgaccaacatggtgaaaccccgtctctactaaaaatacaaaaagtgtaaaaaatacactttggaaggctgaggcaggcggatcacgaggtcaggagttcaagaccagcctgaccaacatggtgaaaccccgtctctactaaaaatacaaaaattagccgagcatggtgacgtgcgcctataatcccagctactcaggaggctgagacatgagaatcatttgaacccgggaggcagaggttgtagtgagccaaaattgtgccactgcactccagcctgggcaatatagtgagactcaatctcaaaaaaaaaataagtttggctttgaagaagaggacagaaatacagcagttgctagtaggaaagatgtgggggtcaagacagcagagaggggagacaagtgcctttaaaagtctgtgactccaagcatggtggatcacacctataatcccagtacgttggcaggccaaggcaggaggatcacttgagcccatgagttggagaccagcctgggcaacatagcaagactctgtcgctacaaaaaattaaagaattagtcaggcatggtggcatgtacaggtagtcccagctactcaagaggctgagatgggaggattgcttgagcccagaagttcatggctgcagtgagcgaggatcatgccactgcactcccgtctggggaacagagcaagcccctatctcaaaaaaataaataaagacaacacaaaaaatttaaatgtgtatattcttcaaaaggttaatagttaccctatgaccccacaatttcactcctaaatctatacccaagagaaatgatgtgtcgtgtctgcacaaaaactcagacatgaacactcaccgcagcattatccctactagccagaaagtggacacaactcaaacgtccatcaacacatacatagataaacaaagtgtagcatatccatccaatgcagcattattcagtcataaaaggaaatgaactacagaccctcctcaactcacgatggagttacagatgataaacccataaaatgtaagtaccagaagtcaaaaatgaggtcacacacagtggctcatgcctgtaatcccaacacttcaggagactaaggccagaggatcacttgagcccaagagttccagaccagcctaggcaacacagtgagacccctgggtctacaaaacatatatatatgagagagagagagataaaaaaacacaaatgcatttaagccagacatagtggtacactcctgtagtcccagctacaccagaggatcccttgaggacaccattgcactccagcctgggcaacatcgtgagaccccatcagaaagtaaggcaggcagcactttgagagactgagggaggcagatcacttgaggtcaggagttcaagaccagcctggccaacaggtgaaaccccgtctctactaaaaatacatggcagggcacagtggctctcatctgtaatcccaacactttgggaggccgaggcaggtggatcacatcaagagattgagaccatcctggccaacatggtgaaacctcgtctctactaaacatacaaaaattagctgggcgtggtggcacatgcctgtagtcccagctcctcgggagactaaggcaggagaatcgcttgaacctgggaggcaaaggttgcagtgacacgagatagtgccactgcactctagcctggtgacagagcgagactccgtctcaaaaaaaaaaaaaaaaaaaaaaaaaaaaaaaacattagctgggcgtgatggtgctcacctctagtcccagctactcaggaggctgaggcaggagaatcgcttgaaccaggaagcagaggggtgcagtgagctgagatagtgccactgcactccagcctgggtgacaaagtgagactccatctcaaaaaaaaaagaaaaaaaaggaaattaagaaagggaaggagggaggaatgaataaatgaataaataaataaataagcatcgaatatacataacctagggaacatcatagcttagcctagcctaccttaaatgtgctcagaacacttagagttaggcaaaatcatctaatgcgaagcctattgtataatagtgttgactctctcatgtaatttatggaataccataatgaaagtgaaaacagaatggtcgtatagattgtttgtttaccctcgtgatcatgtggctgactgggaggtgcctggcaccccaagagagtctcatactgatgctagccagagaaaagatcaaaaatccaaaatgccaagtactgtttgtactgaactgtcacttccgcaccactataagtcaggaactgtctgtactgatgatctatgctacaagaatgtggatgagccttgaaaacattattctaagtgaacgaactcagaccaaaaggtcacatactgtatgattccatttatatgaaatgtctagcataagcaaatccacaggcacagaaagtagactggtacttgccaggcacaggggtaacgggggaatgggaagtgactgctaatgagtatgaagtttcttattgggggtgatgaaaatctacaactgattgtgctgttggctgcacaactctgtgaaaaaaaaaaatatatatatatatatatatattttaggcagtcttgctctgtcacccgggctggagtacagtggcacgatcttggctcactgcaacctccacgtcccacgttcaagcaattctcccgcctcagcctgctgagtagctgggattacaggcacacgccaccacactcagctaattttttgtatttttagtggagacagggtttcaccatgttggccaggctggtcggaactcctgacctcaggtgatccacccgcctcggcctcccaaagtgctgggattacaggcgtcagccaccacacccggtctccgtgaaaatatattaaaaaccatcaaactattcactttaaatggagaactgggcccaggagtggtggctcacaccagcaatcccagcactttgggaggccaagacaggaggatcgcttgagcccaggagttcaagaccagcctgggcaacatagtgaaacctcatctctacaaaaaaatataaacattagccaggggtggtagtgcacacctgtagtcccagctactcgggaggctgcagtgggaggactgcttgagccaggaaatcaaagctgcagtgagccgagatcgtcccactgcactccagcttgggcgacagagagagaccctgtctcaaacaaacaaacaaaaaaaaaggagaattgtatggtatgtgaattatatgtcaataaaggtattttttttttaagtctataaagcgctggatctctaggttcccaggaaagcccaggataggtgaggggagtcacaggaagttgaagggggcttattatcattccactcaccctcacccccccacagccatgacacctggtctttccaaactgatcacctcaagtcatcggtaaaggatccactatcaatagagaacaatgaaggaatgacgactttaataaggcaataaaaagtacccagatctctaaaaggcctcagccctgatatgcttattctacaggcatttagagaggaaaaagaagagatggttctttttaaactaagcttgaaacggtcgattttagatcacagtcttctagaataataatagtcacacaaacatataacgtgggtcatgcttcaaaaatggggcaaacacaaggtttgcatgagtgaaccacaaagctaaattgcacagacactgccgacaggattccatgaacagatgcacagtagagacgatgctggccaagagaaggtagaagatttctcatttgcaaaaccataatcagacatcttcagagttctgggatattttagaccttgttaggagaggaacaatctggtagtcatctaactcacaaataaattctttccactgcacagtacacggatggcacttcttgggctgtcagagatagagaggagccaaaatacggttaaaaatactgatgctcattttttgaaagaaaaattctcagcacttctgcatcgcgctgtgatttaaaagtgtttgtggttatattttctgaaagagtttccttgaaaaatgacagaaggtctctatctcacagccgtcctcataaacaatccctttgtgaaagtcttaatttacatacaacagtgagaacaaggatcctgtgctaattaaggtctggggctggttagcaaattgctataattgtacattctctagcatcctgtctctgaaaacacatccatacccccagcaaatctcagcaagaatgatactgttcaagattttaatatcctgggcttccgctgcatctgtgcgtgtttccaagtcgttcattcccttgtgccggtgacattacacagacatttttaaaaatggtttcagctttggcaggctggcatccacacaccacaagcactaccacaaaacgcacacatggcaggatcaagacgcaagcagcccaaacaggggagcctttgtatggagacgtgaattcaacccgcggagtacatcatttctcaggctgcaaatccctggccttcaaggcgcttgttctgactcacgcatggtgaggccaaattctgcaatgaattgtgccttggccagtctcgcacagggaatgcaaaatgacagccctcggcttcttctgacccggaaatgcgttttgttgggttcacgcatgatctttagagaagccagtctacacagaccacatttctaaatgaggcagttttacaggggaaaagaaaatcccagctggccacagcggatgagccatattcctgctggtcagcaatcagatggaggcaccctccccactttggcacactctcccattcaccaaagctccccttccccctgcatccccagatgccagccacaatcactgatctacctgctgggcccttcaggcatttgacttgcaacccttggaatacaggtcatggttaagtacaaaggtttaaaatctagggacattaaacactcttatcaaaaaaaaaaaaaaaggtttaaaaatcaaagggccagccaggcacggtggctcacgcctgtaatcccagcactttgggaggccaaggcgggtggatcacctgaggtcaggaattcgagaccagcctggccaacacagtgaaaccctgtctctactaaaaatacaaaaattagccgggcgtggtggcaggcgcctgtaaccccagctacaccggaggctgagacacgagaatcaattgaatccaggaggcggaggctgcagtaagccgagataggcactccagcctgggtgatggagggagactctgtctcaaaaaaataaataaataaaataaaataaaataaatcaaagggccgggagtggtggctcacgcctgtaaacctagcactttggaaagccgaggtaggtggatcccttgagcccacgagttcaagagcagcctgggcaacacggcaataaccctctatataattaataaataaataaagataaaacctgaccctagttccatccctactttgacacttccttaattcatctgagcctcagtttccttaactgtaaaatgggaatgacacacccacatcatggaattagtatgaaaattaaatgaagtaatttgcatatcatgccatgaagtactcagaaaatattagccacgcaaacacacctggcatcgagatggcacttcccattgatgtaggagcatctttcagcaggatcattaccctcggacacaaatgtcaacctgacatcttgaaagctcgaaagctttgtctcctgagagctaaaacgctctactaaatgccaaggctggcataatggcaatgactggcttgggaattactcagttaataagtgagtatgtgtcaaggggagaggggcgtaaaaattgaaattcagttagagaaactgaaaggtcacatggactagatgtaggaataggactgaggaattctgcaccaattattgtcagagtttctaagtttcccaagaagaggacggctcagcacctgttttctaagtgcaagtagagaaaaacacgttgccaggttcataagatggtagagtggtcaccttatctccttttgaggacccatctctttcccagtggggacagcgttggtgggtccaggtgtccaggatattagcccttccctggccagagacgtgcacatggactttgcgctattgtccctgaggaggctccgggctggctctactcccgagagtggcctggacctccagccttcccaccaatgcagtgggagcagcttcacaccaacagaccacctgcagtccatccctttcctgctcagaaccgaaggaccctgacccgggtcatgtcacaggggaacagagtccctaaacttcccaagaaaagcaggctggaggaaaaaaaaaaacatgttcactgagcctggagatcatcccactgcggacgctgagatcactgggactgaacaagagataaggcttcatcccggtcagcttcacagacatcatattttcaccatgcagacttcagctctgggaacctcagcaaccccaatcttaaccccaggactttgaatattaagccaagtggctccggcagaaaggtgctctggaaacagaagctaccaccaccgccactcactatggggcacgagagctcagtttcacataacgacaaccaccccagagaatccttggggaaagttctccctcaaaacaaggtgatcccttcccctcaatgattccctaccaaagcaagaattcccaagcacccgagaaaatccttccaaacacctgcagaatggcttcttcaaatgtcacagaggccaacaggacaggaagcttgcagggcagtgcaaagcactggactcctagatggagagaagcaaattcctatctggtcccgagcctgcctgctgggcaaccctacacaattatttctttttttttttttttttgtgagacagagtctcgctctgtcacccaggctggagtgcagtggcgtgatcttggctcactgcaagctctgcctcccaggttcatgccattttcctgcctcaacctcccaagtagctaggactacaggcgcccacctccacgcccggctaattttttgtatttttagtagagacggggtttcactgtgttggccaaaatggtctcgatctcctgaccttgtgatccgcccgcctcggcctcccaaagtgctgggattacaggcatgagccacagtgcccggcccacaattcttcactgtgccccctctaagcagggggtcttccgggcatggtttcctcatctgcctccagaccttcttcctagaggctgcaagtgggggaaatggcagaacagtcattctcaccacctgacagacctagcaataaaaattcactgtctctaagttgatgcaaatcatagctaacatttttgagcagccaccctgtcccaagaaccattcttttttgagacggagtctcactctgtcgcccaggctggagtgcagtggcgcaatctctgctcactgcaagctccgcctcccgggttcacgccattctcctgcctcagcctcctgagtagctgggactacaggcacccgcgaccacgcctggctaattttttgtatttttagtagagacggggtttcaccatgttagccaggatggtctcgatctccttacctcatgatccgcccacctcggcttcccaaaatgctgggatcacaggcgtgagtgaggcaccacacccggccccaagaaccattctgagcattctatctgtgtgagcaaagttcatcttagccataaccttctatctttatcatccccatttacaaaaggaaacctagccacaaggaataactcagctagaaagggggcaagacagaaccaggaaatctggctctagaagccaggtggtttttgtttttttttgagacggagtctcactctgtcacccaggctggagtgcaggggcacgatctcagctccctgcaacctctgcctcctggtttccagcgattcccctgcctcagcctcctgagtagctgagattacaggtgcctgccaccacacccagctaattttctatttttagtggacactgggtttcaccatattggccaggctggtctcaaactcctgacctcatgatccgcctctcaaagtgcttggcctcccaaagtgctgggattacaggcataagccacccagccagaagccaggtgttttaaatctcaatgacaccttgcctctcaaatcattggggtaagtaagaatggtggtccaggggtgcttaaagagggaacttgaaaccatggtgcgcacttacagtcccagctactcgggaggctgaagcaagagaatcacctgagcccaggagttagaggctatagtgtactatgatggcaactgtgaataaccactgcactacactgcagcctgcgcaacacagtgagattccatgtcttaaaaaaaaaaaaaggccggaggcgtggtggctcacgcctacaatcccaccactttgggaggctgaggcgagcagatcacttgagatcaggagttcgagaccagcctggccaacatggtgaaaacccatctctactaaaaattaaaaaattagctgggtgtggcggcgtatgccccagctactcaggaggctgaggcaggagaatcacttgaacccgggaaatgaaggttgcagcgagccaaggtcaagccactgcactccagcctgggcaacagagcaagactctgtctcaaaaagtattttttttaatgtaaaaaaaaaaaaaatacagcagccagcattctagcagagtaacaaataagaaaatacaaagtgaggacaaaggctataaacaaaatcagagggatagaggacgctctggatgctggaaatgtttaattatcttgatctgggtcagggccccatgagtgcgaacgtgtgttaaagttcatcagactgaacactgtagatcaggttaaaatgtaccagaaaatagtaaacaaacggtggacagtagaagccagccttctcactgttggaggaggaggttacagagaaaccagggaataaggctagaatgatccatgtggtaatgcgaaaaggtcaaacgagagaatgaactcatgtttagctgatatagacacagatggatacatgtaaaaatgtttacacagtatgtctatatatccttccttgtctactgagaaaatctagaagcaaggtggctcacacctataatcccagcactttggaaggccgaggtgggcagatcacttgaggtcaggagttcgagactagcctggctaacatggcaaaaccccatctctactaaaaatttaaaaattagccaggcatggtggtgcatacctatagtcccagctacttagaaggctggggcagaagaattgcttgaacctgggaggcaggggttgcagttagctgagagtgcaccactgcattccagcctaggtgacagagcgagactccatctcaaaaaaaaaaaaaaaaaaagaatctagaacaaagacattccagtagcaatgagcacacacttggccaggtgcggtggttcatgcctacaatcccagcactttgggaggccgaggtgggaggatcacaaggtcagaagttccagaccagcctggccaacatagtgaaaccccatctctactaaaaatacaaaacttggccgggcgcggtggctcgtgcctgtaatcccagcactttgggaggctgaggcgggtggatcacgaggtcaggagatcgagaccatcctgcctaacatggggaaaccctgtctctactaaaaatacaaaaaattagccgggcgtggtggcgggcgcctgtaatcccagctacttgggaggctgaggcaggagaatggcgtgaacccgggaggcggagcttgcagtgagcggagatcgcgccactgcactccagcctgggtgacagggcgtgactccgtctcaaaaaaaaaaaatacaaaacttagccaggcgtggtggtgtgtgcctgtagtcccagctgctcaggaggctgaggcaggagaatcatttgaaaccaggaggcagaggttgcaatgagccgagattgtgccactgcactccagcctgggcaacagagggaaactccatctcaaaaacgaacaaacaaacaaacaaaaacgagcacacttagtgcccacatcttggtttctaatactattctccaataaaagaaaccaggatcctctgggtgcggtggctcacacctgtaatcccagcactttgggaggccgaggcgggcggattacctgaggtcaagagttcgagactagcctggccaacatggtgaaaccctgcctctactaaaaatacaaaaaaattagccaggcgtggtggtgcgctcctgcaatcccagttactcgggaggctgaggcaggggaattgcttgaaccagggaagtggaggttgcagtgagccaagatcgcgccaactgcactccagcctgggagacagagcgagattctgtctcaaagaaaaaaaaaaaaagctgggcacggaggctcatgcctgtaatcccagcactttgggaggctgaggcaggcggattgcctgaggtcaggagttcgagactagcctggccaacatggtgaaaccccgcctctactacaaatacaaaaaaattagccgggcatggtgacatgtgcctgtaatcccagctactatggaggctggagcagaggaattgcttgaactaggaggtggaagtcacagtaagctgagatcacaccaccgcactccagcctcggcaacagagcaagactacatctcaaaaaaaaaaaaaaaagaaaagaaagaaagaaaccaggatccatagagaaatggatgattttagggctgaggcaaagacatacaaaatgagcctggaacatcttatagtgccagaagacaagaaagtgctcaataaataaataaataggccagccgggcatggtggttcacacctgtaaccccagcactttgggaggccaaagtggtaggatcacttgagcctgggaaattcaaaaccagcctgggcaacacagcgagactccatctctacaaataaaaagaacaaaaattagccaactgtggtgatgcatgcctgtggtcccagctacttgggaggctgaggcaagaggactgcttgagtccagcaggtcaaggctgcaatgagctgtgattataccactgcactccagcctgggcagcagaacgaggctgtctcaaacgaacaaataaataaaccccacaacgatggagtctgtcaaggggacacaagagccaacacaaagagctcccaactgccaaagctggaatgatttgagcaataaaataaataagtagtattggattacaacccacagtataaagtaaccatcccagagtccacactgctagagataaatgactgaataaatacatgagggagaaaagactaataccccatacagaagaattctaaatttttttttttgagacacagtgtcactgtcacccaggctggagtgcagtggtggaatcttggctcactgcaacctccgcctctcgggttcaagtgatttttctgcttcagtctcccaagtagctgggattataggcatacaatgtttgttatttttagtagagatgggattttgccacgttggccaggctggtctcgaactcctggcctcaagtgatctgcccgccttggcctcccaaagtgctgggattacaggcatgagccaccacatccagcccccaaataatttatgtcaagcctctgctttcgaggaggtggagcatagctcttcactccttaagtgtgggtgatgccttgtgacttccttccaaagagcagaggatggaaagagaagaaagacagccagatggtcatggtcaacatcaacagtgataaatctttttttttttttttttttttctttttgagatagtctcattctatctcccagactggagtgcagtggcatggtctcagctaactacaacctccgtctccaccccctccaccccgggttcaagtgattctcctgcctcagcctcccgagtagttgcgactagaggtgcctgccaccacacccagctaatttttgtatttttaatagaggcagggtttcaccatgttggccaggatggtctcgaactcttgacctcagatgatccccccaccttggcctcccaaagtgctgagattacaggtgtgagccactgcacaaggccaacagtgatagatcttattaataatacatacccttgatgtgatatgatgaaaatggcattttaccctctgtagtcttcttcctccccaaaacccataaccacagtttaccagagtctaatcatgagaaacacattatacaaatcccaattgacaggacaatctacaaaatacccgaccagtattcctgaaaaccggtaagttccacaaaaacaagaaaagtctaagaaactgtcacagccaacaggagcccaggcagacaactaaatgtaatgaggaatcctgagtgggattctaaaacggaaaagggacttttgtgggaaaccgaaggaaatctgaataagggatggcctttagttggtaataacatatcaaaattgatgcattatttgtaacaattacaccacactagtgtatgatgttaataatagaagaaattgtgtgtgtggagccaggggctaacatgggaactcttggcactatcctcaaaacttttctggaaatctaatactactgttaaattaaaagttcattttaaaaatgtaatagaaaattggccaggcatggtggcacatgcctataatcccagcactttgggaggtcaaagagggaggatcacttgaggccaagggtttcagaccagcctgggcaacccactgcgacctcatccctacaaaaaaaaaatttttttaattagccaggtgaggtggtgtgcacctgtagtcccagctactcaggaggctgaggtgggaagatagcttgagcccaggagattgaggctacagtgagctttgagcccaggagatcaaggatacagtgagctatgatcataccagtgcactctagccaggacagtgcagtgagacgttgtcttttatatatatatttaaaacagaaaataatgaaatgactccttcagactccgtggccaccaaaagcctctttgaggagccaccatctgagataagtctgagatcacaatgagaaatgggcagcctgctcctggcaaaagacacacaggggccccaaggaaggaaccaagaggaaggaggccaaggagctcaagtgaagttgggggagaaatggcacaaggtgaacagaacatcacaaaggaaacaaaggtaaacagggccggcccaggtaggcaggtcacggtgacttcagacctgagtggaagggtactggaaaatcatcagaaggagttagcaaaatgagacagaacctgacccactttttttttttttttttttaagacggagtctcgctctgtcccctaggccggagtgcaaaggcgtggtcttggctcactgcaacctccgcctcctgggttcaagcaattctcctgcttcagcctcccaagtaactgggattataggcacatgctgccacgcccagataatttttttgtattttagtagagatggggtttcaccgtgttgcccaggctggtctcgaactcctgagctcagacaatccacccgcctcgccctcccaaagtgctaagattacaggcgtgagccaacgcactctgtccacttttttttttttaatagagatgggggcgggaggggggggtctcgttaagttgcccaggctggtttcaaactcctggcctcaactgatcctcccacttcagtctctcaagtagctgggatgattggcatgcgccactgtgcctgaccccaatccacgtttttgaagcgcattctggctgctgaagggtgaggatgggagtaggagaaaagagagaaagagacaatggtcactcagcttggtcatgcttggatagaatctaatccaacaccccacttcacaaatacaaaaatgaagggacagagccagtgtccaagccccctggggaaggtaagcagcagaacagggacaagacccccaccctcctggccccctctcttcagtccctctccactttgccccgtctcctgatggaccacatttgattctgaccacaacaagggggctgagaagtggctgagaggcacgtgctcctgcaacatcaaaaacacctctgtgagaaggtaccttccttgctctgaagtccctggtggctcagctctcttcaccatcaatggcactgaaacttcctgccacccagcacaggctgggtcatgctgtgatgagggggcagcagccctctgcctccgcccagcctcctcctgctgctccccagcacacagcacccacccagtaagccaggccttcccacccagggtgcctccccttctgtgacccctgccagagatcagcagccagcttctgcttcccaggtcccagccttgactactggaccctcaactttgccccaaaatgacatactgtctttttttttttgagatggagtcttgctctgtcgcccaggctggagtgcagtggtgcgatctcagctcactgcaacctccgcctcccaggttcaagtgattctcctgcctcaacctcctaagtagctaggattacaggcgcgtgccaccatgcccgactaatttttgtatttttagtagagacgggggtttcaccatgttggccaggctggtctcgaacgcctgacctcgtgatggtccgccttggcctcccaaagtgctgggattacaggcatgagccaccacgcctggcgacacgctgtcttgtaacaatcctcaaaatgcttttggtttcagacgcctttagggagtcactttgtgcgacactctgcagccaaatgagaatctccttccggcagtatgcagtaaccctgtccagcctcttcctccctccccataacccccagtgcaaggctgtgtgttccaagaaagcactcagtgacttgttgaaggaatgaaaacaccttggtacaaccattaagtttggagatgagccttttcatcaaccaaagatacgaaaaatactccagtagctcatttgtgaaagcaccctgaaggtaaaagtgaataactgcttcattttgggaagcctcataaaatctctttcacaaagaccaaatgaaaagtaccaatccctcaattagaagatattcaggagtctactccaggcttgtgaataaacgcataaattgtgtttgtcctaatttgctaaattttgaactaaatgcaaacactggccccggcatcccagcaagctctacatttcctttttatctctaacccaagaccaccactttccagtgaagcgggctgacttcatcccacttctgggattccaaagaggtctgttgttaaaatcagaaaacgagcagcagctagaggctctggtggcttccagaacatgctttatttaaactgtggctcctgaaagtcaccctgcggagaggtagccagccaccctcagtcatgacacacaggtaaaattcactgtcaggacccctacacaggcaccagggaaagaaaaccaaaaggaggagagttctccatcaattaggttcatccatcaaaaaatcttatatctgaaaatccaagaagagttacaacgtcggctcagagagccacacacttcactgcactacaacaacaaaaagaaattccaatttcctccttagctctagaatagataatacaagatttttactcacctttggagcgagtagagatatccatgccctctaccacctcctgttctgtttttatttcctcttcagccaagctgaaacagagcaaattatgttcatgtttaggaaggctgagaacttgccccatgggggcagctatttggaagttctagcaacaaacacaccttaaagacattccctcatccttatccagggctgggggaggaaacccacacctgatttcaacaaagtgtgaagagtcctaaaggagttttttaaaacactaggttgttctttttttttttaagtcaaattactattccagttgtcatgctattggggaatgcaaaaggcaattttttagacacacaattacaacctacccctgtgggccaatgagaacccagccttcaaataaacaagcttctcattgttaacacagggttcaaaggcagggaggttggaggtgttttgcagggtatccagaattctgatcgctgaatactttagggcaaagagtaagatttcccacacctccccctaaatcttacaattccctgatgaggcaggaacatgggaaaaaaaagatacaggttaaattacaaagcagaaaaatatgcccagctagaagctaaagacctggtctcaaaacactgaaccgaggagcactgattccagcaatcagactggggtctccacacttccaaccccctgaatgcttcctctctacagcaggcacggcttactactgagttgtgactaattatcccccaccacaaaagtggaatgaggaaggattattcaaaagacaaaggctaagagtggagggttggggagagaagcaaataaagcaagcccctttgctgggagggtccgtcacccagaacattctctctctctctctgctggaactagggttgaaagagagccggccatatcagatcttcctcccacagagaactcacaagctaaaccaaagggaaaaaatagagttctgctttcatagatgcaaatggtttgaggtgctagaactttccaaacattcaggctgacactgaagtggtaagaagctgggcatttactccagaagcaattccatcagactgtcgttccacaggaagaaatgggtgcatcaccaattgatatggctggaattttccatttggaagactcaacgccaggacaggaaggaggctggggaagagagaatgtcctgtcctggggaagagagaatgttccgtggtctgggactgtgacaacgcaaaaggcccaaaaagacagcctcatgtctcgaaccctagtataaggagaagattttaggagagttccacgttaggaggagaggacttaggatgggagctagatagaatggaaaagattatagttcagagttaaattataggggcttggagacgaagaaaggtagttgggtttaaatgagaatattaacacatttagccatctgattttgaaccccgttaacaatttcatttacaccgcatctgtaaagaaagcctgtgacacaaatcaccaaagaaacaactgacatgttgtcacaaatggttttcatcaggagaaagcagcctgctaaatttaaacacatcgcttatatgcaataatacaacggtgatttattgaaggttatttcagcactaatgctttctattccaacttaaggagaaaacattctcaactcagaaacactctgcctgaaacatacacaggttgtccaactggatgctgttgatgggttctggcttggggtgactggaaatacatcttaacaaaaagccccatgcagccctcggagatgggtagacagttaacttcaaaggaacaaatagcaaccttgatcttttctagcaactagaattctgtttccctctctagcatgaagtatgtgaaattctaaacttcttgaaaccgatcccatattttgagtaatagagaaaacgctaatctgtgatccaactgaaatctacagtggtgagggaaacaattatgcagaactgagccaaaaaaaacccacttgaaggatttctgcagcgatgaaaacattcaaaggtgtattgatcatggaggaaggctgcattcaagggaaccattatttggcttgtaacagcctagaggagctgaatacttcaggcaggaatgctgctgagagacgaggaaaatgcaaactagttatgtggtggctatttgcttctgagttttaagataatcaatgctggagcagaagagagagggaaaaaaaagttaagctgttttatctttccaagtattacaagtgggcaccataatcacccaactttagcaatagcaccaccagctttagcacagcatttcaagcacaacaatttaagaaaaccatctttttcacagatcagcaaaccatcctttcaaaaggaacccgtgcacacacatgcacgcacactcacacacacaattaacttgtatttgactaaaggaaactgcagtgtctatgcattaaaaggagaaaaaaaaaaaaaaaaaaaaaaaacttcatttacaaaagcaaagaccagaatgcaaaattagtcattttgaatagccacatctaaagggacttcctttttcctacaccactgatttcggtttttttgtgtgtgtgtgtgtgtttttttttgatttagtgttaagaactagtatgttattaggaaaaaaaaatgaatattacatcaaaagtaggcgcaagaaaagatctgtacctgtctgaattgccccactgatgttggtcaatttaggttaagaactgttcagtcatttgggggaaaaaaaacagtcaaataattcttaaaaagaaaaggcagctgcatctggagaaaatactctgaacttctgtcattaacacattaaagtcttagaacatagacagcttatttccttccatatctgctagcttccagcaaccctgatgatttaaatcaaaaacaatgggacaacaagctcttgtttcaaactgacattacttttttccctttaaaggtctgttgaggaaactgggggcccgctacagaaaagggtaaaattagctgaaaagcaaacaatttctcactccaataggaaaatacaccatcaactagttagatacattgtatacaccaccacctcttacactcacatttacccaagtcatttgcctgcagatttcacaaactgatacatttgaggcaattcaaagaaataacagtacctgcaaagataaccaagaccaccccatcccatcccaaaaagaataaaagatttctcccccagtgcctgagcaagaaaacctatgcttacttcttaacctgcatgcactgaaaaaagagcaattaaaagttgcagatgaactactgcacctccaggatgctttaagccttctgattgttaattctgaggactcagggatggtccgtaattcccaggaatctcatctcctcaacacttccaagagagagaaaaaagaaagcatctagttttgacagaaaaatgcctgaatacacaatgcccacatatttcttttccccaagtgcccctactatttgacttttaaagaagagtatctaagccatctagaatatataaccaacatgcacaagactctggttctacagatgaggatcatcgcacagcaattcaagaatcatgcatcattcgaaaggacttttcctggtttttacttttcattcaaaataccaaaatggtccaggctgtaagaaatatttaatccccaaggcataacatcttcctcttctagattacaaaatagtgaacatcaaaattaaaaaccatgcttccctaaatctacaattaattttttaagaaattggggtgggggggaatggttagcagagcagctttatataagcactcacctaaaacaggcagagtcatcggtagctaagctatttatgcaggattcttaaaatggcgtctggcaacactgcctcattcctgtgttgaagctaaaatggtagcagtttgttcaatagctgtagctcttgtttaagcagccctgcgagtttcaaagccaccttcctaaataccagaactaggaaaagctgaaccaaaggacaccaacaacccaacgtttagaagcttaaaaaaaactctgcaatgacagggagagtttgtgaagtcacaggttcctaaggaaaagccttctcttgtagatcctgagccttcaacatgaggctctgtgatgaggcccccttgccctcaaattaggtgggtagaaggttaggaatcgtgcagccccgtggcacaaactgcagacggacaggtgtctgtgcaaacacaaaaatgttcccagggagcagcctgggggaaggcaaggaggaagcccggtcccccttctcttctcagtctattagaaaccagctttgcatccataccaaaaaggcgctaggtaaaatgaaagtgcttcaaggacagcaggcatctgaaaagccaagctaaagggctgcacctcagtctacggcaaaggtaaaataaaaaggctgtttataagcctgcaaacagccaccaaatacccagccctctgaagcagccagtcctaagacagttaacatcaaggaaagacaatccgagtctgcagaggagaaacacaaggaaaacattcccttatccaatgcacaggatactcacaaattagatttctgaccacccccaacagagcctgagaattaacaatgggttttgcaaaacccgctttcagaggccgaactaacagcctgagtggataacgtcatttactgttacaggtctgagcattggcctcagaactcctctggtgctgggagtgaggagtttcaaggtgactgctttttagctccaggggagaaaggagggcacagtgcccaaggccatgccagggcaaggacgggccactggcccccgccggccggtaggtaaggtaatcgggatgggggggacaggctggcagcacactggctgcagagctggcatggccactgcctgtttgtttgtctgcaaggagagtgggaagtagcggggagggtgaccataaccttagcaacctgaagccaagggtgaacccttgctcagatcttgcattttaagagtaaccaaagggttctgaaacatattccctttttaaatctctgctgtgcagtagcgaaggcccctttgaatgtatctttctttccagagtcaaccagaggcaaagccagattgagggttcccaggctgacaaatgtctgctgcctctgccacaggagagagaaggggaaagagggcaaaagaaacaaagacatcacgcgttgcaagtggctggacttttaaaaacctacctttgcctccagggttttctaggttactgtcaccccacttcctaaaaagtgtctcccccctcatcctatttaagacctgatgcagtctccccactggttctcccagggaaagaaaaggggaaatgttttgttgaaaataaaagggatgacaagaaagaaaggaaaaaaagctattgttttcatccctaatttataatccaagaggcccccaattgtttctttctgactcaaatctttgagctgttaattataaaagtaactggacttggcgccaacgggctaactatgatcaggctcagcaattagaaaaactctgtagaaagtttactgagtgattatatataattaattcctagttacagactgaacactgaccattttctggagctaataaaagcagttactccccctcccccacgtgaatgccacttaatttcccaaagcagaaagtgaatccatcctggagggtcttgaaggaaaaaaaaggagaggaatcaaaagcttcagtgtgtctgtgtttgctccttgcagctgtgtatcctctttggggactgaggaggcagaaggaaaaaggaaaacagcccaacattctgttcctccttctgcaatttacaaacgtggcagagagaacattctaccttgatgagaaaaagaaggggggttggggggaagcagggaagggagatgacctaggaatggaaggtaggagacgcttctgcttggcagatctgcttttcctaaaaggaacaaagatggtagaaatttccagaaggcccgttcttagttcggccactgcaattgtcaatctttaacctttcctccaagtctattggtttaaaagctagagtagaagaaccccattgggctgctctgggagccagtactgccgtccctacctagtcctgctgcaatgcagacatttatttttttccccctttcctgaaactggaaaataatgctactttgaaagcaattaactttttacagactcatgcttggtaggggtcacagtaccagaggaaaagtggctagcttggtccagggttgggaacttgctgggggctgtacatttgaaaacagatcttggctctccaaacctgtgggagccattttaatgcaagcttttagaggacaaatgccttgcccttaagttcccttccagcccaacaaacacagtattatgcaaacgttgaaggcaccaaaccaggagtcttatgattagatattgcttctagggaggccacaagaacctcgatatgtaatttccatttacagcaaggagataagaacaaagaaaatagctgagtgtctgaacttacttgtttggggcagtggcactgttcagttttaagtatataacatcattaactgcctgcagttttactctaagaagctaagctggcctgccttgcacagacttttctcaacttagaatgtggtacgtttctgctgattaaatgagcctttttccaattcggtgtcagaaagtgggctactggacactcatttgaaagaaaaaagattactgactccataaagttgacataacacagcaattgaatatatttcctgcatttacggtcatgtcggattggtctccaagctgaaaatttatgtactgaacttctagggaaattctgaaggtactgctaaacaagactctacttttcccacttaacttctagctgcagccttaagtggtcaagggaaatgtaaaaagtgagaaatcttatgtggggccagcatgcatacagatgtgtggaggagacctgaaaaaaggccaaaatgtgttggtcagtgagtcctgaatcaaacccagtctggtggtagatgagattttgcactatacataagtcctaaaacatgagcacactgacaccacccccccaacacacacataccaccaccaccaccagcttctacaccaccaatgtttttagggctctgcacctctaagaacaagcagtttcatgacatttcacaagcacatcacctactcacagtttgaatatccaaacaaaccccattaaaggtctagagtcaagtcacaatgaactgaacatttctcccctgactcagggtaaacaggaagtataatcttcaatcctagctgcaggttatcaggaaaaacagtggattcaaacagtcacctaaaatcaagacactctttaaaaagcccttattttgttcctgctaatgaagcccccaactcctgtagccaagacccactattacaaacagaccccaaatgttcgcaaaactcttcaaacatggtcacagaggaaatggattgctttacttacccaacaaatgttcaagcaaccgtctcatttttccacagttaggaagagagaacaggctggcagatttgggacttgatcaaaaaggaaatttttttaaacagttacatggtattattaaaaacacacacaacaacaacaacacaacccaacaactgaatatggaatgctgtcatgagccacagacatgattttatttcctctacactccatgacacaggagaagagaggaggatacaatgtataaaagggacaggaaaatgaaaacaaggataaaaggtaacattagttccttgaaaatcatgcaagagtagaaagctaagggattcagaatccttgcagatttttttttttttttttttttgcaggatgttgtccaagatctctccccccaccccccagtccccatccctactccaaaaaacttcctccaaagcctagaaaacactttcagaaacatttgctggctgtaggctggcttgcagaacactctgtagcaacctaagtcaggaaaacaggctgaacaatgtagtttcaagtgcagaagctctgtagaataagagaagaccgtgtacagacaccaccacccacctaggccccaggagctagactctccttagcactgctctgctgagggcacaattcttttgcaaacacgctcctctcttgtcaaaacttatccagccttcccagaacctctttggagaggcaaacttgcctgctctgctgtctgccatgagctctccttggagaggagcctgtttgcttaccttccattttcttcccccagcagggcatgtggcaaaagagaagacaatagtgcaggggtgggagggggggaactgctcagagagagagagaggggaagagagagggaagagggaaagaaaaaaaaaaaaagaaggaaaaaaaaaagcttcttttttggcataccaggatctagcttcaaactcttccagaaacaccatgccctggtggaaggaaaggtgtgccaggcccttgccagtttgcaaaatcaagctatggctaatggctactgagccatgtgacccaagaaagcaaaaaaattctctctaaacagttccaagttaacataagtgctctgggggtgagtgtggcacggccagccacagagaaatcacactgctcgcccacaattcggatgtctcagagggagggggaaaaaagatggttaaaaagtcgagcttacctctgtggatgcattgttaacactgtgtaatgtcaatacttataaaacatggaggacaggctcctagttctcacagaaaaagggtttggcacttcggctgatgatctggccgcctaataaaagctcatccccgattggctgccccggcaaatcggagtgtaaagccgccccggattggctgaaacacttcctgagcgattatctttgtgaggctcgggtgagcaagagccatcctgtgcatagaaaaagacaggctaagctaggccttttgcagcaagaaaaacttgggaaaggggcccccacacgcacttctcctgcaccctggctagatttcccggcacgggccagccagggcagccagcctgacctgctccaggaaagcctgaggcccggaggtccctgggaagggagtttcttggagtgggctggaacggctcaccctcacctgcccccagagaaacggcccttgtccagggaggaaggccagcctttttctagaacagtccagcagggtggctctccaaggggaaggggaagctggggagtggggagtcccggggaaacagccaaggggccagaaaaaggggcttgaggcaggcctctgagaagctgggggaagcaggcagcccgggggagccccgaaaaatcagcagagagcagccctggcttctcagaggagcgaggagtagctgctgaggggaggaggggagcagagtggtcaagtttgcatagtcattgtccccatgcctccttgcaaggcaggccagggagccgtgggcctctcgcgccctgcttagccagtcctgcaggcaaaatcaacgtgggttcctgtcgccctgccacgatgccaagggggacccctctcggtccttaccctaagaaaaacccaaagccctcctcgcaggccacatgcctggatctacaaacttcccttccctcccggcccctcccccgcggccgagacctgctaaacctgtcagttaaacacaaatctgacttccgtattagcctgcgatgccttcggcttcctgcctgttaaccctctctcggactcggggcctggctgggaaaaactaggccttgagatcgcagcgaaggcctgtggaaaaataccagctgcagctctcccggcagatgcagaaagagagagagagagccgctgtctctcagcctttgcttcccagggaggcgtgtaccttgtgaatccagggcacaggcagtgcctctcgggctgagaagccatttcaatccagagggagacagaaagatggcacgctcagcccggaaacaagagcccccattatgcgtcaggcctacccccgtaggtcagcccttcctgccacaatcatccctgtatgtgtgtgcctgggggagttgggccctcctcggtgggcagacaaatcccctgggcttcctaaggattcttgcttccatttatttgcacagagaacggcttcttttcgtcccccaaggcagatggagcagcgatttcacacacagccctccatttggcagcccccccacccccccatctctggcaccgctccccagtaaaatattaactggttgttcagagctgcttacaattctacccacttcaattgcgttaggaggtctttgctggtctcctccctaaagctgccttcgcagttggtctgtacccagagatagaaaaggaccgtaaaatgtccccagctttctcgctctctttccttcttcggcattttaaatgacaaggtgcttaattaacaggattttttaaaacagcaacctggaaccacagaagctaaataaacaccattctttagaggctggagaaagcgtccagagttaacgcagccatatgccaggaggcataactccggagcaataaagtctcccctctcctcctaaaattaggacttgtgggctttcttgtcccacacggttcccacaaagaaaacgaagagctgatggcttgctttccctgcccccccccaacccccacatggacaacagatgcccactgcttgtacataaattcttcctggccgggaatctcatatcaaacaggctcaggaacgagctgggaatcgaaactcactgtacggcagggcaggacccaggctttataaaaacggacaggatgttgctgttgttactgttttaggctgctgaggccaagctgcagggagggacagctccatggccacccaacctgacaaagctccagggctcaggacagcaggcctgggcctcaccaaaagggaggggcctgctcttcctggaggtagaaagctgcatggggagactaaatgggaggaggcgagaggtggaggccacagtgaagcagtgcgtgctcaccctcctagctgtgtgggcagcggccctccaccgccatcccatatggaatgctgtttgtttctgcgggtgctgctttgaggggaacaaacaggactgtggggttggtggcagatctcccatgcagctaagtccacgaaccaatgaggaaataaaatatgccgctggtgtgcgtggtggattttaacctgggattaaagcttgttgcataagcagctacagcatcctccccgcctccctccctctctctgatcacttgatcacttgaaatgttttctggggcaaagagcaggaagctgctggcttattctggcagctctgctctgtttgaggaatgctgttggcattcgggtaggtctgaggttatctggaaaacagcaattcggctggggacagacacaaaagtatggtggcagatggaatcctgggaggaacacagattgaaaagaaagcctggggcaggcctacgaagggctggtcctgggcttcatggaatgtggctgataagcaggaaataaaaccaaatgttgcaggtctcaatctagaaatccattcagcagctcctcttaaagccccactgcagtgagtatcccagcagttacttctaaattagtgctttacatagactgattcctgaagtaggtggcattgttagaaacctggaactaagcccagagaggtgaagtgagctgcccaaggtcacacagctgggaagtgccagagatcagatgtccaccccgttagcacttcacatccctaaactctgtaccttctcctggctctaaagaaagaagcaaaagcaaagccgaaccaagcacagcagaaacaatgaggctgaaacctacgaacagcaactgcataatctgtgttttcttttaggaggtagaccagttttttgcttttttgttttttgatacagtgtctcgctctgtcgcccaggcttgagtgcagtggcatcatcacaactcaatgctgcaacctgaagacccacccttttgaggtgggttttcagtattgaatgatggcgctgaaggaaacttttagattagactcattcaaatgcccctcattacagattgaggcccagaggaagcgaccctctccctcccaacctccagcaagatgcaagatgtcaagggggaacactttgccatctctaaaattaggcttttatattccctgaaaccagtggttcaaccatggggggatttgcccttcagggggcatttggcaatgcttggagacgtgtgggttgtcacagttagggaggttgtattaccggtatccagtgggtagaggccaaggatgatgcaaaacatcctataagtacacaagaccagccccgccacaacaaggaagtatctgatccaaaatgtccaaggttgggaaaccctggctttaagccctttaaggaaagggaagaaaacagtccaatcattctgcctctggctagaaaagccagcacaggcctaaacaagcaggttctttggtgatattaataagcaatgagctaataaaaatagattaaaacgtgtctctcttaatattcccagggtacagagaggattggggtacagaatcaggctgtggggagccaggcagagtgtcacagtaacaacactggtctcgagggagaggaaaggctggccccagctcccttcccccagcaccttacgagctgaggcctggcctccctgaaatggctcgcccgttccgctggcctccagccaggcgagcagcagcaggagcggccccacaagctgcatcccgagatagcctgttcggctgcctacaaaaataagcacacttgcagttatcggcctccagctacagcaggcctctctgaccgttacgcgaaatggacaggattgagtcagggaagtgttttaaatatcttgttttgttttgttcctttctggccaattagaaccgaggccaacttcgggcacggtgacagaagggctcaccttcagagcccggagctgactgtgtcatgttacagccacaaagaggcagataggagcctccctcccttggagaagatgcctactaggagaggggtgtggggttttttggttttgttttgtttttttacctctttctaggagggactggcaggattaggcaaacggcgggagggaaaacaaaaagggctagtggaaagggcagggggtggatggtcgcccctcatcaggcagatggccacagcgcgggtggggcgccgagcaagggatgcaggagcagaaggaaaatgaaaagcaggaaaactcaggccctactcttttttcttcctagcaattacttttatgggcagaagactatagattcgttcgctctgtttctccctcccactggaccggtggttttgcccccgcaaggggacatttagcaatgcctagggacattttgggttgtctccattttgggttgtaagatctttcagggaagtggggagtgctactggcatctagtgctgctaaacatcctacaacacataggacaagaccccccagcggagaattagccagcctcaaatgtcaatagtgcagaggctgagaaactgtgcaccaggctgagcacttcacgaggcaaggaaggaccttgtctgaattcttcaccatcatgccctcaagagttgaacacagcacttgacatatattagagctcagtagaacaccatctcccatccggatggttgcaagaatcttacctgagctctctgcttccgcccttgcaaacgcttgtacacatgcactcacacacacatacacacactgtaccacccaggctgccagtgatccttttatttttttttctctccctttttttttttttttttttgagacaaagtctcactctgtcgcccaggctagagtgcagtggcacaatctcagctcactgcaacctccgtatcccaggatcgtgcaattctcctgcctcagcctcctgaggagctgggattacaggcacatgccaccacacccagctaatattttgtgtctttagtagagacgggggtttcaccatgttgtccaggatggtctcgatctcctgacctcgtgatccgcctgccttggcctcccaaagtgctgggattacaggcgtgagccaccatgcccagccacttatttattttattttattttttctgagacacagtctcactctgtcgcccaggctggagtgcagtggcgccatctcagctcactgcaacatccgcctcctggattcaagtgattctgctgcctcagcctcccgagtagctgggattacaggtgcaaaccaccacgcccggctaatttttttttttttttttgtatttttagtagagacggggtttcaaatttcaccatgttggccaggctggtcaggaactcctaagctcaagcgatccgcctgcgttggcctcccaaagtgttgggattacaagcgtgaaccaccgttcccggccagccagtgatcctttcaaaacacaagtcagctcctgtccttcctctgctcaaaatccatcaatgactcctatttctcagtaacagcccaagtccagataacggcccaccagcctcccggctggcactgtgcccttctgacctccgaccatctccctccaccctcctgtggctcactctgctccggccactccgatcatccacctgttctttccattctctaacttgttctctcctccttggagccgtggtacttgatcttctactctgacccttcctacaatcaatggatctgcccacttccccaaaccacccagcagctagccatttcctccgcggggcctcaacatgtctgtatcttccctgctgcttctgaaaggattccccacagccgacaaggcctctcttctgctgcaccctacatcagatatctttccatctgagccctggcttaaaaactagccccatttctcttgcacctgtaacctttttcctctctcttccccacatcaagaagcacaactgtgcagtgattgagtgtgtggctgctggtgccacactctctgggtgtggatcccagccaccccacttgccagctgtgcggccttgcttgaagtactaagttctctgtgccttgattttctcatcagtacaatgggaacaaaaataaaaagtgcctggaatcattgaataaatcatctctaccaaaagcttgcagcaacgctgcacagagtcagcactcatttagttgctgttactatttccctcttggcttactcttatttttttttattattattattttttttttttggagatagagtctcactgtgtctcccaggctggagtgcagcggcgcaacttcagctcactgcaacctccacctcctgcgttcaagagattctcctgcctcagtctccagagtagctgggattacaggcgcgtgccaccacgccgggctaatttttgtatttatagtagagacggggtttcaccatgttggccaggctggtctcgaactcctgactcaagtgatccacctgcctcagcctcccaaagtgctgggattacaggcgtcagccactgtgcccggccatcagatacgattttaaacgctttacatgaaccaacccatttatcctcaaaactataaagcaggcaccattatacttatcaacccactcctatatgagtaaactgaggtcaggactaaccatcccattcttttttttttttttgagacggagtctcaccctgtctcccaggttggagtgcagtggcatgatctcggctcactacaacctctgcctcccgggttcaagcgattctcctgcctcagcctcccgagtagctgagattacaggcatgagccaccatgcttggctaattttgtatttttagtagagatggggtttctccatgttggtcaggctggtcgcgaactcctgacctcaggtgatccgcccgcctcggcctcccaaagtgctgggattacaggcatgagccatcgcagccggattttttttttttttttttgagacggagtctcgctctattgcccaggctggagtgcagtggcgcgatctcggctcactgcaaactccacctcctgggttcacgccattctcctgcctcagcctcccgagtaggtgggactacaggcgcccgccaccacgcccggctaattttttgtatttttagtagagacagggtttcactgtgttagtcagaatggtctcgatctcctgaacttgtgttccacccgcctcggcctccgtaagtgctgggattacaggcgtgagccaccgtgccccgtcctgtttcccagactgcagcgtgatggcaagatgacagctcacagcagcctcaaccaccttggctcaagcaatcctgccacctcagcctcctgagtgtctggggtcacaagtgtgtccaccacacacagctaattttttttttttaattttttactagtttttttgtttgtttttgagacagagtcttgctctgtcaccaggctggagtgtggtggcgagatctcagctcactacaacctctgcttcccgggttcaaaagattctcctgcctcagcctcctgagctgggattacaggcgcatgccaacacgcccagctaatttttgtatttttagtagagacgggatttcaccatgttggccaggatggtctcgatttcttgaccttgtgatcctcccgcctcggcctcccaaagtgctgggattataggcatgagccaccgcacccagacttaattttttatttgtaagagacaggggtcaggctgggcacggtggctcatgcctgtaatcccagcactttgggaggccaagacgggcagatcacctgaggtcgggagttcgagaccagcctgaccaacatggagaaaccccgtctctactaaaaatacaaaattagccaggcgtggtggctcatgcctgtaatctcagctactcaggaggctgaggcaggagaatcgcttgaacccgggaggcggaggttgctgtgagccaagatcgtgtcattgcactccagcctgggcaacaagagtgaaacaacgtctcaaaaaaaaaaaaaaaaaaaagagacaggggtcttgctctgtggtctgggcagatctcaaactcctgggctcaaatgctcctcccacctcagcctcccaaagtgctggaattacagatatgagccacagtgcctgccggtttatctgctttagatagtgtgggcaggaagtggggagaccctttaaggaggctgtgacattggagcgaagaacatagaaccttcctggtggagggaacaggaagtatgaaggctctaagttggtctgagcttggcagtttgatgtttcagcggaacaaaaaaaggccaggtatggctacaccaaataaggtgcaaagaggctgggtcccatggctcaatcctgtaatcccagtgctttgggaggctgaggtgagcagattgcttgagcccaggagttcgagaccagcctgggcaacaaagcaagaccatgtctctacaaaaaatagaagaaattagccaggcgtgctagtgcacacttgtagtcctagctactcgacaggatgaggtaggaagatcacttgagtcaaggaactcaaggctacagtgagtggtgatcatatcactgcactccagcctgggcagcagggtgagattctgtctcaaaaaataaaataaagtggccgggcgcagtggctcacgcctgtaatcctagcactttgggaggccgaggcgggtgggtcacgaggtcaggagttcaagacccgcctgaccaatgtggagaaaccccatctctactaaaaatacaaaattagccgggcgtggtggtgcatgcctgtaatcccagctactcaggaaggctgaggcaggagaatcgcttgaatccaggaggcagaggttgtggtaagtcgagatcatgccactgtactccagcctgggcaacaagagtgaaactcagtcgaaaaaataaaaaataaaaataataaataaataaaaatacaaatacaaaaaattagcacacgcctgtagtcccagctactcgggaggctgaggcaggagaatctcttgaacccgggaggcaggggttgcagtgagccaagatcgcgccaatgcactccagcctgggcgacagagcgagattctgtctcaaaataaataaataataaaataaaataataataataataataataagatgcagaggaccaggccaggcatggtggctcacatctgtaatcccagcactttaggaggcgaggctgaggcaggcagatcacgtgaggtcaggagttagagaacagcctggtgaacatgttgaaaccccgtccctactaaaaatacaaaaattggccaggtgcggtggctcacacctgtaatctcagcactttgggaggccgaggtgggtggatcacgaggtcaggagttcgagaccagcctggccaatatggtgactcctcgtctttattaaaaaatacacaaaattagccaggcatgctggcgcatgcctgtaatcccaactactctggaggctgaggcaggagactcacttgaacctgggaggaggaggttgcagtgagccgaggtcacgccattgcagtccagcccaggcaacagtgcgagtctccttctcaaaaaaaaaaaaaaatcaaaaattagctgggcgtggtggtgggcacttgtaatctcagctactcaggaggctgaggcaggagaattgcttgagcccaggaggcagaggttgcagtgagccgagatcccgccattgcactcctgcctgggcaacagagactccgtctcaaaacaaaacaaaaaaaagatccagaggacctaagcatggagataagctcagagacaaggtcaccattccctccaccatctttccattactaagactcaaaatattccacaatgttctttaccttcccatccccactctcctctacatctaatccacaccatccctgaacccaccccaaaagagagccctataaaagggtagctagacatgtacactcaagcttaagacagactgactctgcactgtgtagctccagaaccccaaataatttctgtaactctctacacctgatcctccacatgtaaaataggaatactactctctatctcatcgggttatacagtaaatagagaaaatgaattaatagatatgaaaatacctcccacaggtggatcacctgaagtcaggagttcgagaccagcctggccaacatggcgaaaccctgtctttactgaaaatacaaaaattagccaggcgtggtggtggacgcctgtaatcccagctacttgggaggctgaggcaggagaatcgcttgaatccaggaggcaaaggttgcagtgagctgagatcatgtgctgcactccagcctgggcgacagagcgagactctgtctcgaaacaaacaaacaaacaaaaattagccgggcgtggtggtggacgcttgtaatcccagctacttgggaggctgaggcaggagaatcgcttgaacctggtaggggatggaggttgcagtgagccaagattgcaccacttcactccagattgggtgaaagagcgagattctgtctcagaaagaaaggaaaagaaaagccaggcgtggtggctcacgcctataatcccagcaccttgagaggccaagggggacggatcacttgaggtcaggagttcgagaccagcctggccaacatggtgaaaaccccatcattactaaaaatacaaaaattagccaggtgtggtggcacgcgcctgtagtcccagctactctagaggctgaggcaggaaggcaggaaaatcacttgaacccgggaggcagaggttgcagtgagccaagatcatgccacttcactccagcctgcgtgacagagggagactccgtctcaaaaaaaaaaaaaagaagaaataaaatacaataagataaaataaaataatgtattttggctgggcacagtggctcacacctgtaatcacagcattttgggaggctgaggcaggtggatcacctgaggtcaggagttcgagaccagcctggccaacacagtgaaaccccatctctactaaaaatgcaaaaaattagctggacgtggtggcaggtgcctgtaaccccagctactcgggaggctgaggcaggaaggcaggagaaacccttgaatccgggaggcggaggttgcagtgagccgagatggcaccactgcactccagcctgggtgacagagcgagactccgtctcaaaaaataaaaacaaaaaaattatgtgttgtatttgcttttcagggcagcaatcttgtcctttacaagcacttgattcgacggttcatctccagagcctagagtaggtcccacacaggggagtctgttgatttgagtgaacgtcaattcctggggctcagtacaaatgctttaaaacaatttgctcaatactgggcacaataggcttaatgtggccttgctaagttcctggagtgacttctatgggctttagcctcctcctgctgccaccactgcctccatcgccctcctcgttgtcatgacgacatctcctcctcctcatctttaccttggaagagtggcttgcacttattgaggtgccatgtgccaggcactgttccaaacacactttacgtattaattaatttaacccctccaacaaccctatgaggcaggtacaaggataacccccattttacaggtgagaaacctgaggtgcagagagatcaagtaatttacacatctgaaaaaaggaaaacattcataagaaaaatgaaacctcagcctacttggcctctaaaatttcaagaagctaaaactatggagaaaccaacacttacaggtgatcaggaaccaatttaccaacaacagcagcaaaaaatagaccaaacacaaacagaaattccagagagggcaattcaatcacaattcatctcgtgttctgaggccccccaaacctccctgtgttttccatccacctggtccctcaagtcccagatctggacatcacccttgaccaccgcttccccatctcccatcccaagccctgtggcttcaccttctgagcgccttccactgccgactgcggcggcgtagctccattctgcacaggtgcttggctccagagccaccattatctgctatctgggctggaagggaacagcctcctcaccccgactctgctcccatcctccaccctcagctgctggaaggatcttttgaaatttcaatttgggccagatcacatccccatcccccaacccccacctctaaaacccttcacaggtttcccattgttctcaggccacagtctgaaattcttcaacgagccctagggggcctgtaggattcccttctccagcttttgctcagggtctgagctccagccagcttcaaagactgagtgagtttgcctggattcaaatcttggctctgcctttcactcactgtgccaccgcatgtaagtaacttaacctctctgggcctctaaagtggggataatagcacctcctagagtgttgtcaggattaaattaattcatgtagtaaaaagtgctcacttagcacagcatctggcacccagttagctattgctattgttattgctgtcaggtaactcctactcatccttcaaaacccaacacaaaattcatttcttcaggacagccttcccagactcatttcccaaaaaaaatcagatcctaggctgggcatggtggctcacgccagtaatcccagcactttaggaggccgaggtgtgtgatcacctgaggtcaggagttcaggaccagcctggccaacatggtgaaaccccgtctctactaaaaaatacaaaaattagccgggtgtggtggcgggcgcttgtaatcccagctactctggaggctgagacaggagaattgcttaaacctgggaggcggaggttgcagtgagcgagatcatgccactgcactccagcctgggcgacaagagcaaaactctgtctcaaaaaaaaaaaatcagatcctccagttatatggtgtcctcatagtgcccatgacaatcataatttaatactttatacatgtttaatcaccaggtacaaattttattttattttttttgagacagagtcttgctctgtcacccaagctggagttcagtggcccgatcttggctcactgcaacctccatcccaggttcaagcgattctcccacctcagcctcctgagtagctgggactactggcacgaaacaccatacccaactaatttttgtattttttgtagagacggggtttcgccacttgcccaggctggtcttgaagtcctgggctcaagcaatccgcctgccttgaactctcaaagtactgggattacagatgtgagccaccgtgccgggcaggtataaattcctatgatcgagttcttacctactgtctgttttgttcaattctgtatcactctggcacatagtaggtgctcaaaaataatttggtgaatattggacaagagagtagctgaatgaatcagctgcagaggagcccaaatccccacttttcaagttaaataattagaaaaatcggcttttggccaggcgtggtggctcacacctgtaatcccagcactgtgggaggccgaggcaggcggatcacgaggtcaggagatcgagaccgtcttggctaacacggtgaaacctcgtctctattaaaaatacaaaaaaaattagccgggcgtggtggcgggcacctatagtcccagctactcgggaggctgaggcaggagaatggcatgaacccgggaggcggagcttgcagtgagccaagattgcgccactgcactccagcctgggtgacagagcgagactctgtctcaaaaaaaaaaaaaaaagaaaaatcggcttttaatgaggatgcaggaaaactgaagcccactgagggtaactgggttacaaaaggaagccgcagtgattccaatgtaaagcaaaactgggagcgtggcccagagagctgcagtgcaggggctgggttagcctaagagctgactacttggtattcacagcaagcagctcaaacaaagagagaggagagggacgaattccatggggagctgaaggccaaaggcccgaagctgaaggcagaagtggtggattaccctgggggcgggaggcttccagctgcagaaatcgcccagattctaggaatccatcccacccgtgcccctgctcactgctgtcttacctgaattgcctgcccgcaacccttcggctcaccagcctcgggaacagtgactcactccaatgcctctggtcccagctacagcccaggcctccaccagcctgatgtcagaacctctgtagggtggccaggtctagcaaatacaaatacaggatgcccagttcagtttgaatttcagataaacaaggaatcttttttttagtataagtacatcctgtatcagtctggcacctctacctctctggtcccatcaaactctccccagcaatgtcctttcacagttacctttctgctgctcagagtcttgagcctccttggaagataaactggccccctgtgacctctgggtaagggagaaaccaacgccagccgaatagggtggggtaaggacctccccgccaccaccaaaaaaaaaaaaaaaaatgcaggcacagtggctgaagcctgtaatcccagtgctttgggaggctgacttgggaggatccttgaggctaggagtttgagaccagcctgagcaacacagcacgatctcttctctacaaaaaattttaaaaattaactgggcttggtggtgcacacctgtagtcccacctactcaggaggcagaggcaagaggattacttgagcccaggagttcaaggctgcagtaagctatgatcatggcactgcactccagcctgggtgacagagcaaaaccgcatctgagaaaaaaaggaaaaataaatgacctacccagttcttagcacagaatacattctccataaaaagcaacttcatacagccatcctttactctacggtcacctaggggcctctcacaagtccttgtgagatacatggcatggatggttgaacccttttcacagaggagaaaactgggggcctgctaattggtggaagggccaagaagaaaagtcctgctctttaggattctgctgctaaagctctgctggagtctgtcagatgtgaatatgcaggaaactataagccacatgagagcaggttaactgtggcttcaccgatggactcctggatcccagcacagtgctccagcccttagcagctgctccggaaataactgcagagcagctgagcgtgatgcctcacgcctgtaatcccagcactttgggaggccgagaggggcggatcacttgaggtcaggagttcgagaccagcctggccttcatggcaaaacctcatcgccactaaaaacacaaaagttagttaagtgtggtggtgggtgcctgtaatcccagctactcaggaggctgaggcagaagaatcgcttgaacccgggaggtggaggttgcagtgagccgagatcacaccactgcaccctaacctgggtgacagagtgaaactctgcctcaaaaaaagaaagaaataattgcagagcgaatacaaatccaccagagtctccacgacgacctgataatagagcacacacttgtggtcaggccccttctctcaatctctctctctctctctctctctctctctctctctctctctctgtctctcccctgcacccctctgccctgccccatgttctgggtcttgagcccaggtctgtctttctgtgctgtctccgtagccccaactacatggctacgtggtggggagaaggagaggatgaagcttaaggcagatttctggcttttctccccaaatgaagcaaaataacaaatgtagcttcaaaaggaaagcagcatgatcatggaaatgtcaaaacagccacgttcttttctagccaggcagaagagactttatagaacctgactcaacacagttgcattcagcattccttaaacacctaacataagctcccctttactggcaaattgccctgaaacaattaggaggtaaaggaattcccagaagaaaaggattttctagggcctttgaagagatgtgttgactctaacccaaacaaccctctgagaacatggagccacttggttagctctctttgagagttgtccaacaggtaaagcaggggcatccaccagtatctgtttttaattgcttctgtctttacccaaggtcagaaatgaacattgggatttgactgaggagttactttccatttcttacttatgttttctttattcagttatagggacagggtggccatggggatggtgagggaagtttggactttgagaccattttgatcagggcctttactctttataaatgggaagtgacttgcaggcattaataggctcatcaggttctcacctttggtgcatctcccccatggtcagtgccagcctagtcatggatctcgacctgatcagtggacttttctccataaactttccctaacacctggagagatacttcagctgcaatgtcacctcctcagagaggccttccttgattgcattatctagaggagattcccacccagccctgcccagcagtcaccctctatgaggtcacctgttgtattgtcctatgaggactcctatcaactatcacacgctgttgcttttttattattattattattattattattattattattattattattatttgaggcagagtttcactcttgtttcccaggctgcagtgcgatggcacaatctcagctcactgcaacctctgcctcctgggttcaagcgattctcctgcctcagccacccgagtagctgggattacaggcatgcaccaccacacctggctaattttgtatttttaatagagacagggtttctccgtgttggtcaggctggtctcaaactcccagcctcaggtgatccacccgcctcggcttcccaaagtgctaggattacaggcttaagccaccacacctggcctattattattattattattttaaatttatttattttgagactgagtttcactctatcacccaggctggagtgcagtggtgcaatctcggctccctgcaacctccatctcccaggttcaactaattctcctgcctcagcctctgagtagctgggactacaggcacgtgccaccatgtctggctaatttttgtattttttgtagagacggggttttgccatgttggccagtctggtcttgaactcctgacttcaggtgttccaccggcctcggactcccaaagtgctgggactacaggcatgagccaccgtgcccagtcttatttttttgagacggaatatcactttgtcacccacactggtgtgcagtggcacgatgtcagctcgctgcaacctccacctccctggattcaagaggttctcctgcctgagcctcctgaatagctgggattacagacctgtggcactgcacctggctaatttttgtatttttagtagagacagggtttccccacgatagcccaggctggtctcgaactcctggcctctagtgatctgcccgcctcagcctctcagagtgctgggattacaggcacaagccaccacacctggcctgttgctttatttttgacttgttggtctcttggtctctgcaaccaagatgacagatgtcatccgactgtcagcagcatgacgacagggccttgtctggcttcttcactgtggattcccagcctcaagaaggcaaccaggcccatgtgtagccactgagtcagagcctttaacaaaaaggataaagaagaagaagaaggctgggcgcggtggctcacgcctgtaatcccagcactttgggaggccgaggtgggtggatcacgagatcaggagatcaagaccatcctggccaacatggtgaaaccctgtctctactaaaaatacaaaaattagccaggtgtggtggcgcacgcctgtagtcccagctactcgggaggctgaggcaggagaattgcttgaacccgggagaaggaggctgcagtgaaccaagatcactccactgcactccagcctggcgacagagcgagactctgtctcaaaaaaaaaaaaagaaaaagaagaagaagaagaagaagaacaataataataatgacttacattaagtgtttgctaattgaatccttacagcactgtgacatagtaggtacattgattttgccactttgcacttgctgttccctttgcccggaacactcttcccaggtgtttgcaggacttttctctccatgcaggtctctgctcaaatatcaccaactcagagaggactttcctaaccccctccctaaaggagtgccaagcatcactccctaatcccatatcctgtggttaaggatttcactgtgtcccttctaaaaagatatgttaaagtcttaacccccagtacccaaggatgtgacttgatgtagaaatgggattttttttttttttttgagacagagtctcgctctgttgcccaggctggagtgcagtgatacaatctcggctcactgcaacctccacctccctggttcaagcgattctcctgcctcagcctcccaagtagctgggactacaagcatgtgccaccacgcccagctaattttttgtatttttaatagagatggggtttcaccgtgttagccaggatggtcttgatctcctgacctcgtgatccacccacctcagcctcccaaagtgctgggattacaggcgtgagccaccacgtctggcctgaaataggatctttacagaagtaatcaagttaaaatggggtcattaaggtgggccctaatccaatatgactgatgtccttataaaatgaagaaatctgaggccaggtacggtggttcacacctgtaatcccaccactttgggaggccaaagcaggtggatcacctgaggatgacctctggccaacatggcaaaaccccatctctactaaaaatacaaaaattagccaggtgtggtggtacacgcctgtaatcccagctatttgggaggctgaggcacaagaatcacttgtacctgggaggcagaagttatagtgagccgagatcacaccactgcactccagcctgggcaacagagtgagacttcacctcaaaaaaaaaaaaaaaaaagaaataggatctttacagaggtaatcaagttaaaatggggccattagggtgggccctaatccaatatgactgaagttcctataaaaagaagaaatctgaggctgggtgtggtggcttacgcctgtaatcgcagcacttgggagactgaggcgggcggatcacttgagccctggagtctgagatcagcctggccaacatggtgaaaccctgtctctacaaaaaatacaaaaattagctgggtgtggtggcgcacagctctcaggagctgaagcaggaggatcacttaagcacaggagtcgaggctgcaatgagctgtgatggtgtcattgcattccagcctgggtgacagagtaagaccctgctgccaaaaaaaaaaaaaaagaagaagaagaaatctaggctaggcacagtggctcatgcctgtaatcccagcactttgagaggctgaggtaggaggatctctcaagcccagaagttcaagactagcctgggcaacatagcaggaccctgcctgtttgaaaaaatttttttaaattatcaggggttggtggtgtgtgcctctagtcccagttacctgggaggctgaggcaggtggaccacttgagccaagttgaggttgcagtccagccttggtgacagagtgagaccttgtctcaaaacaaaaaagaagaaatctggacccgtggccgggcattggtggctcatgcctgtaatcccagcactttgggagaccaaggcgggcagatcacctgaggctgagagtttgagaccagcctgaccaatatggcaaaactccatctctactaaaaatacaaaaattagccaggttgtggtggcacgtgcctgtaatcccagctacttgggaggctgaagtaggagaatcgcttgaacccaggagacggaggttgcactgagccgagattgcaccactgcactccagcctaggtaaaagagcaagaccctatctaaaataaacaaacaaacaaacaaacaaataaaaaagaaaggaaggaaggaaggaaagaaaaaaaaagaaaagaaatccggacacagagacagacacagacggaagatgatgtgaagacagaggattggagcaatgcatctacaagccaagacatgccagaaattgccagcaaccacctgaagctaataggaagaggtaaggaggactgtcccctacaggtttcagaggaagcatgtccctgcccacacctcgatttgagacttgtagcctccagaactgtgagacaatatatttctgtagttttaagccacccagttgtgctgctttgttttggcagtcctagcaaacggacacacttgctttatttttctttatttaaagctctgatagccacctgccactgcacacatttatttgcctgctgactccctgcacccaggatggactgcaggtctcttgaggctgaggtctcatgttcatatgttcatgcatctgttacaagggctggcatttactccttccttcaggaactattcatttgagtgcctactatgccaggccctgccttcttttttttttttttttttttttgagacaaagtctcactttgtcacccaagctggagtgcagtggtgcaattctcatgcctcagcctcctgagtagctgggactacaggcatgtgccaccacacctggctaattttttgtattttagtggagacgggatttcaccatgttgcccaggctgatctcaaactcctgacctcaggcaatccacccgcctcggcctcccaaagtgctgggattacagacagagtgagccaccgcgccctgccaagccttggctttttgaagtttacattctagtaagaagaaacaggtaataaacaataaacagataataaaaaacaacaataagtaaataataaacaataaataggaacaataaaataggtagtgtgttaaatggtgatgagtgctatggaaaaaaatatagcagcaagggagatggtggggggttggggtgggcaacggtggtcatcagtgtagacagaggcctcaccaaggagctgacagctgagcctgaataagatcaaggaggaggcgtgggggattttgggggacagcagtacaggttgaacaggggttcccagcaagagcgattttgccctccaggggacatttgtctggaaatattagggagttgctcctggcacctagtgggtagaggccagggattctgctaaccatcctgcaatgcatggaacagccccataacaaagaatggcccagctggctgggcacggtggctcacgcctgtaatcccagcactttgggaggctgaggctggtggatcacgaggtcaggagttcgagaccagcctggccaacatggtgaaaccctgtctctactaaaaatacacaaattagccaggaatggtggcatgtgcctgtaatctcagctactcaggaggctgaggcaggagaattgcttgaacccaggaggtggaggttgcagtgagccaagattgtgccactggactccagcctgggcaacagagcaagactctgtctcaaaaaaaaaaaaaaaaagaagaaaaagaagaacggcccagccacaaatgtccgcagcagtgaggttgagaatccttaagggagagggaagaggaagccctcagcctcggagtgccctgcagggaccaggtgttggaggaatagccaaggcgatcactgctcagatgttttactctctgggaggacaccgtggtggggaaggttagagggtactgaggaaacagaaatatgtcgcaggccattttaagaagttcagtttttactctaaataagaccagaaatcactggagactttctgcagataagagacacaggctgacaagttccacaaacatcactctggtcatggggttgcaaatcgactgaagggggccatggcagatgtagggagactagtggggatggttggaatgttccaggcctgcgatgctggtggctcagagcagggtgaaggaggacagcaagtcaggattctggacctacttgggaaatctagttgtcagggtttgtggagtatgggagggaggaagaggaggcatggatgacttcaagatctttgttgttgttgtgtttgtttgtttgtttgtttttgagacagggtctcgctctgttgcccaggctggagtgcagtggcgcgatcacagctcactgcaacctccgcctcccggtttccagcaattccactgcctcagcctccggagtagctgagattacaggtgcacgccaccacgcctggctaatttttgtatttttaatggagatgggatttcaccatgttgaccaggctggtctcaaactcctgacctcaagtgatccacctgcctcccaaagtgttgggattacagacatgagccaccgcaaccgtgatttgttttgtttccaggctggagtgcagttggcgccatcatggttcactgcagcctctacctgagctcacgtgatcctcccatctcagtctcctgagtagctaggaccacaagcccacaccgctatgcccagctaatattttgaattttttgtagagacagggtcttgctctgtttcctaggctggtctcaagctcctgggctcaagtgatccgcccccaccttagccttccaaagtgcttagacttcaatatcttctgacctgagctgctggggggctggagttggtgcgggctgagatggggacagtagtgggaggaacaggctgggggaggatgaatgtgggggtgagctattagtcatccaagtggagatgtcacggaggcagtcggatgatggagtgcaggggaagtttgggctggaagtataaatgtgggaggcatcagcatctagacggaatttaaagccatgacgcatatgggctgagatcacctaggactgtgcgtgatgggaaagaatcgggtccaagggccagtccctgacactctccacagcttggacatttggctgtgagaatgaaccaacaaagatgacagccgggtgcggtggctcatgcctgtaatcccagtactttgggaggccgaggtgggcagatcacctgaggtcaggagttcaagaccagcctggccaacatggcaaaaccccatctctactaaaaaatacaaaaattagctgggtgtggttgcaggcacctgtaatcccagctactcgggaggctgaggcagggagaattgcttgaatccgggaggtggagtttgcagtcagctgagatctcaccactgcactccagcgtgggtgaaagagccagactttatttcaaaaaataaataaaagaaaaagaaaattgctccttcaagccacgtaacaggagcagagaaggaaaggtgggtcgaagcccagcttgggcattttccaggtgtgaccttggacaagttccggccttccccagttaccccatgacactgctgtcaaggatagaggagatcatgaaaagtgaagagcctctcagctttgtaaactgtgaagtgccttctaaggatcagggtgattgccaactgagcatttctataacaccaccactgaaataaaaactcaaggtcgcacagcttctgctgacatcattcagcagagaacagatgcagaatttccaacctttcaagagctgtgcaccctgttagcttgagggccaagaccttaccacttcctgaccaaaacataatgcatacagcatattaacctgaaaaaaattctaggaaatagaaaaacatgcatgtagtaaataattaaaatggcatagaaacgtatccatggggctgggcgtggtggctcacgcctgtaatcccagcactttgggaggctgaggcgggcggatcatgaggtcaggagttcgagacctgcctggctaacatggtgaaaccctgtctctactaaaaatacaaaaaattagccgggcatgatggcaggcacctgtaatcccagctaattgggaggctgaggcaggaggatcttttgaagctgggaggtggaagttgcagtgagctgagatcaagccattgcactccagcctgggctacagagcaagactccgtcttgaggaaaaaaaaaaaaattagccgggcgtggtggtgggcgcctgtaatcccagctacttgtgaggctgaggcaggagaatcacttgaacctgagaggcagaggttgctgtgagccgagatcgcaccactgcactccagcctgggcgacagagcgagactccgtctcaaaaaaaaaaaaaaagactttgctctggtcaggagtggtagctcatgctgtaatcccagcactttgggaggccaaggtgggaggaccaattgagtccaggagttcaaggctactagtgagctatgatcatgccactccactgcactccagcccaggcaacagaatgagaccctctctctaaaagaaaaaaaaaaaaaagccaggtgaggtggctcacgcctgtaatcccagcactttgggaggctgaggcgggtggatcacttgaggtcaggagttcaagaccagcctggccaacatggtgaaatcccgtctctactaaaaatataaaaattagccgggtgtggttgcctgcgcctgtaatcccagctactcaggaggctgaggcagaattgcttgaacctgggaggcggaggttgcagtgagctgagatcatgtcactgcactccagcctgggcgacagagcaagactccatctcaaaaaaaaaaaaaaaaaatttataaaagcacagggtcttccagaaattgtggattaattggtctggggagacgaccaagcatttgatttttgttgttttttttttttgtttctttgagttgtagtctcgctctgtcacccaggctggaatgcaatggtgcgatctgcgctcactgcaacctccgcctcaaaggttcaagcaattctcctccctcagcttcccaagtagctaggattataagcacctgccaccatgtccggctaattttattgcatttttagtagagacggggtttcaccatgttggccaggctggtcacaaactcccaacctcaagtgatccacccgcctcggcctcccaaaatgctgggattataggtgtgagccaccgcacccaggttgatatagtttttaaagagccccagctgattctaatgtgtagccacggttgagcgccactgttctagaaaactacaagtttaaactagaacaaaaagaggcattttggcccggcacagtggcaaacgcctgtaatcccagctacctgggaggttgaggcagaatcgcttgaacccgggaggaggaggttgcagtgagctgagatggcacaactgcactacagcctgggcaacagagtgagactccgtctcaaaaaaaaaaaaaaaagcagggggaggggaggcattttggcatgtccatcactaatgggatatacacgcacaccatatcctgggttgtagctttgcaggcagtaaatctaattttttaatttttttcaatttcagctccactcctaactaactatgatttagggctgtagggaagaaaaagtaccttttcctcacccatcacaaggttcatggctaacacccctaaagacagattaacaagagataagcatgacaaatttatttaacccaagttttgagtgactcaggagtcttccaaagtgaagaaccgtgacccagggcacctgtgtttttatggacagtcaagcagcagtgtcacaggaggacaaaagggtttgatccaatgatgtacacagtgggaacttagcaaggcctgtgagtttagtcttcatggtctccacggacaggaccggaccccctctggaatgaggggcttggggcctactttcaggagaggcaggtcagagaaaccttgagtggcccactgcagaagaggaaggcaggagaaggtcagagagtgaccttcctgcttctatggtttcctcaaattccttcagcttcaaatgctcagtttgccaaagtgctgtaatttggggtattgtgttccaaacccctacaggagaagtccctactgctctaagcagacttgagcaggcatcagaagcacgtgggcagcttgctaaacactgattgagggactcacccccaccaagtttctcagttgaaagatttgagaatctgcatttcttgaaattctcaggccttttgattaagaaactcttttttttttttttttttttttttgacagagtttcactcttattgcctaggctggagtgcaatggcatgatctcggctcactgcaactttagcctccctggttcaagcgattctcctgcctcagcctcctaagtagctgagattacaggggcccgccaccacgcccagctaatttttgtattacaggtgccaccacgcccagctaatttttgtatttttagtagagacgggggtttcaccacattagccaggttagtcttgaactcctaacctcaggtgatccatccgcctcggcctcccaaagtgctgggattacaggcgtgagccatcacacccggcagattaataaattcaatcaaggactttgggggaagtggggctgagaatttgcatttctatcaaacgccatcagaatttagcaggtgctgctgctgatccagggaacaggctttgagaaccagggctcagttgattactagtataattaacaacctctgatcccatcactggctcccatttcagagcaatggttggtgcctgcaagctttcatctcactgtgtccacacacaatcccatggggtcccagtgttcttatggatgaggttaccacggctgcaacattcacagtgaattgtccagggtcacgcagctgcagccaaagtctggggtggaacacaggtctaattacaagcaggagagaacctgggcaacactttctttgggagcatcaaagcaagctctcccaccacctgcttgagcacttccaaatcctgccgacatacccaaccctgcaacaggcaaagagcctcgcctcctgctgggagagcagcttcttgcggcgcggccttcgcgaaactccgtggagaaatggcgccccctggtggctccagagagagcagcgttccattctccgggctgggagctctggtctcatgcgtcatggacattcttggaccccatcactaacatggaaaatattattcagtccattccatcctaggaaagaactcagggtgctgaaaggaggtggggacttcagagctcaggaatgtaaaggaagggcggcggaccgagccctggggctctcagggggctggaatggttaaagcacagctgagaacaattcggagtttcacctttgaccttcccaaagacttctgctgaggaattttctttctttttttttttttttctttcagacggtgtttcacttttgtcgccaaggctggagtgcaatgtcgtgatctcggctcactgtaacctctgcctcccgggttcaagtgattctcctgcctcagcctcctgagttgctgggattacaggcgtgcaccagctaatttttgtatttttagtggagacggggtttcgccacgtttggccaggctggtctcaaactcctgacctcaggtgatccacccaccttggtctcctaaagtgctgggatcacaggtatgagccagcgcgcccggcggaggaattttcagtactaaagctatagtgttgtgatgagagtccggcgtgctccctgaatgccggtgcccgattcataacctagtgcattcgttcacacattattcattcaacagataagcttttgcgtgcagtactattctgggtgctgggaccaccgaaatcagcagaacagacagaatctttgccttcacggatgcctcctgccctagaacagtgaatgaatgaatacatcaataggtagaacacatggaaaatagatgacacttaataaagagatgtcattgagatgacacttaagcaaaacccggagtgaggagaaagagcaggtatctggtgaagaagtgttccaggcagagagaatggtaagagcaaagcccccggggcgtgggtgtgtttctctaacatgtttgagttcttttttttttttttttgagacggagtctcccgctctgttgccctggctggagtgcagtggcgccatcttggctcactgcaagctccgcctcctgggttcacgccattctcctgcctcagcctcccgagtagctggtattacaggtgcccgccaccacgcccggctagttttttgtatttttagtagagacggggtttcaccatgttagccaggatggtttcgatctcctgaccttgtgatccgcctgccttggccccccaaagtgctgggattacaggcgtgagccactgcgcccggcctttttttttttttaaattaaaaaaataagggccaggcacagtgactcacgcctgtaatcccagcactttgggaagcctagtggggtgtattacctgaggtcaggagtttgagaccagcctggccaacgtggtgaaaccccatctctactaatttgctgggcatggtggcacgcgcctgtagtcccagctccttggggggctgaggcaggagaattgcttgaacctgagaggctgaggttccagcaagccgagattgtgccattgcactccagcctgggcgacaagaatgaaactgtctcaaagaaagaaaaaaaataaaaataaatatggtgctgggcgtggtggctcatgctgtaatcccaccactttgggaggtagaggtcaggagttggagaccagcctggccaacatggtgaaaccccctctctactaaaaatacaaaaattagctgggcatggtggcctgtaatcccagctacttgggaggctgaggcatgagaatcacttgaacccaggaagcgaaggtcgcagtgagccaagatcataccactgcaccccagcctgggtgacagagcaagactccgtccccctcacccccaaaaaagagagagatggggtctctctatgttgcccaggctggtgtcgacctcctgggctcaagggatcctcctatcttggcctcccaaagtgctaagattacaggcatgaaccactgcgcccagcttgagttgttaaaaaaattttttttgtagagatggggtcttgctatgttgcctgggctggtcttgtactccagacctcagccagtcctcccacctcagtctcccaaagtgctaggattacaagtgtgagccaccacgcctggcctagactagactgttgatgatggagtgggatgtatctcttcatatccaagaaccacttaccctgttattaattcgacagtttttattaaatcaacttattttgttttattttttgtttatagagacagggtcttgctatgttgcccaggctggtcttgaactccccagctcaagcaatcctcctgtctgggcctcccaaagtgctaggattacaggtgtgagcccccatgtctggcctgaaataaacgcagtgtttttttttttttgagacagtcttgctctgtcgcccaggctggagtgcagaagtgtggtcttggctgactgaaaccaggcaaaatctgggccgggtgtgctggctcatgcctgtaatcccagcactttgggaggccaaggcagggggatctcctgaggtcagaagttcaagaccagcttggccaacatggtgaaaccctgtctctactaaaaatacaaaaattagtcaggtgtggtggtgcacgcctgcaatcccagagctactgaggaggctgagacaggaaaatcggttgaacctgggaggcagaggttgcagtgaaccgagaccgcaccattgcactccagcctgggcaacaagagcgaaactcagtctcaaaaaaaaaaatctaaataggccaggcacggtggctcatgcctgaaatcccagcactttgggatgccgagacaggaaggtcacttgagcccaggaattcaagaccagcctaggaaacagagtgagaccctccatctctactaaaaattaaaaaaattagcccagtgtggtaacacatgcctgtagtcccagctactagggaggctgaggcgggaggatcgcttgagtctggaaggtggaggctgcagagagccgtgatagcaccactgcattctggcctaagagaaagagccagaccctcacacctaatcccagaactttgggaggccgaggtgagcaaatcacgaggtcaggagatcaagaccatcctggctaacacagtgaagccccgtctctactaaaaatacaaaaaattagccgggtgtggtggcaggtgcctgtagtctcagctactcgggaggctgaggcaagagaatggcgtgaacctgggaggcggagcttgcagtgaaccgagatcatgccactgcactccagcctgggtgacagagcgagactcaaaaaaaaaaaaaaaaaaaaaaaaaaaaagccagacactgtctcaaaaaaaaagaaaagaaaagaaaagaaaaacctgaaatacttatttcagcctgatagagtccattgaggagagaacaggaacaggagagaaaggggagatggtagcgataaacatgccttcgagaaattttactaaacaaaggagcagagaaatgggaccctctgtggaatgacatccccagaggtgtctagctagataagacagtaagatttgccgggcacggtggctcacgcctgtaatcccagcactttgggaggctgaggcgggcggataacttgaggtcaggagttcgagaccagcctggccaacatggtgaaaccccatctctattgaaaatacaaaaattagtggggcatggtgggcaggcccctgtaatcccaggcaggagaattgcttgaacctgagaggtggaggttgtagtgagccaagatcgcaccactgcactctagcctgggtgacagggcaagactccgtctcgaaaaaaaaaaaaaaaagatttaagtgcatgttgacaccttgtatcgtcccaggatttggggcctgggtcttgccttgtttctagataatctggttcagtgccaagattttaaatagcatctccatgctgatgacttccctattcatatctcctgtctcctgcacacatccaaatctacagactggctggcgttctcagccatcaattgtccagaacagaactcttgactggctcttgtcccaccctctgccccttccatacggcttcataaggatgagagtaaggagtggtccttgttctctttttcctctcacttggcttccaggccattagcaagcattgagggctcccaccctcacccccatctctactgctcccatcttttagtctctctgtctccacccgtggcccatgaatcacttttccactcagcagtcaggcagatctgaaaaagtaaatcaagtcacgccagtcttctacttaaaattcaacatttttatccaggacaaccagaataaaaaccaaattggccaggtgcagtggctcacgcctgtggtcccagcactttgggaggccgagatgggcggatcacgaggtcaggagatcgagaccatcctggttaacacggtgaaaccccatctctactaaaaatacaaaaaaattaaccgggcatggtggcgggtgcctgtagtcacagctactcgggaggctgaggcaggagaatgacgtgaacccgggaggcagagcttgcagtgagctgagatcacgccactgcactccagcctgggcgacagagcaagactctgtctcaaaaaaaaaaaaaaaaaaagaataaaaaccaaattttttttttgaaatagggtcttgctctgtcactcaggctgaagtgcagtggtgtgatcacagctcactgcagcctggatcctcctgcatcagcctcccaagtagctgggaccacaggtgtcccccaccacgcctgagtttctttttttttttttttgagatggagtgtcttgcttgtcacccaggctggagtgcaatgccaacatctcagctcactgcaacctccacctcccgggtttaagcaattctcctgcctcagcctcccaagtagctgggattacaggtgcatgctaccatgtctggctaatttttatatttttagtagggacagggtttcaccatgttggccaggctagtctcgaacttctgaccccaggtgatccacccacctcggcctcccaaagtgctgggattacaggcatgagccactgcacctggcctaattttttaatttaaaaaaaattattattattattattattttttgagacggagtctcgctctgtcacccagctggagtgcagtggcatgatctcagctcactgcaacctctgcttcctgggttcaagcaattctctgcctcagcctccagagtagtcaggattacaggtgtctgccaccatgcctggctaatttttgtatttttagtagagacggggtttcaccatgttgaccaggctggtcttgaactcccaacctcatgatctatctgccttggcctcccaaagtgctgggattacaggtgtgagccactgcgcctggccaattttttaatttttatatttgtttgtagagatgggggtctccctgtgttgcccaggctggtcctgaactcctgagctcaagcaatcctctggcctcagcctcccaaagagttgggattacaggtatgagtcactgtgcctggccccagactctcttcagtggcctccaagttcctccatgatcttttcctggcctctgatttcatctcatacattctctgccttcttcatcattttgttctccaagagtctatcccctgccacgcccacaccacccccaccactggcacctcttgaatttctcaaactaagattcctttccaatggcatattgcgtgggattctctcttccagtatctgcacatggccagtttcttttcatccatctcaacttaaacatcacaggtagatgcttttgtgcaaacacaacctccctgtccactctgccccacatccacatgtggccttgtcatgtggccacgcctagctgcaaagaaagctgggaaatgtaatacttaattgggcagctctgtgcttccttttagtcacatcccccaagggcagcactatcttgattactcaccgtgacatgcgatttacatttacacaaatagcctccggtttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgcctcctgttttttttttgagacgagtctcgctctgttgcccaggctggagtgcagtggcgcgatcttggctcactgcaagctccgcctctcaggttcaagccattctcctgcctcagcctcccgagtagatgggactacaggcgcccaccaccacgcccggctaatttctttttttcatttttagtagagatggggtttctccatgttagccaggatggtctcgatctccagacctcatgatccacccgcctcggcctcccaaagtgctgggattacaggcgtgagccaccacgcccagccagcctcctgttatttatacttactcttcactctgttttgaatatctcttttactccaatgctgatgagttcctgtcacctggattccaggacttgcctcagatcctagccttccagaagcctagtttcagccttttttttttttgagacggagtctcactctgtcgcccaggctggaatgcaatggtgtgatctcggctcattgcaacctctgcctcccaggtttaagcaatcctcctgcctcagcctccctagtagctgggattacaggcgtgcaccaccacgcccagctaatttttgtatttttagtagagacagcgtttcgccatattggccaggctggtctcaaactcctgacctcaggtgatccgcccatcttggcttcccaaagtgctgggattacagggatgagccaccacacaaggcctccagcctttcttttgagtcaataagctacaccatattctaccaatatttttacttgagtcagcagtggtttcctacacctgcaactcaagaactctaagggttactgcctccattgtttgttaaggcaccacaagactttgctgaactgtacataatgctttaggtcaataaaataatcatcatcataatgacaactgaggagaaagtcatgataatatcaacctattgagcactatggtttttttgttttattttgttgagacagggtctctgtcacctagattggaatacagtggtgtgatattagctcactacaacctctggctcttgagctcaagccatcctcctgcctcagcctcccgagtagctgggactataggcacgtgccaccatgccccgctaatttttttttttttttaagtagagacgaggtcttgctatgttgcccaggctggtgtcgaactcctgggctcaagctgggctcaagctatcctcctgtctcagcctcccagtgagcactatattagttagcacatagattctgtacaaagatcaagagagaacagtctactttatttcccatttagtagtccatctataaggggttgagagctatttgggtggcttcctgttctctggctgggccccaggctcctcctatcttgttgctcagtgtcctcaacacatggcttccaccttagggaccaagagagtcactccagctcctgcaggaaagaaaggaagagagagggagggcactctcttttccatttatggtcttggtccaggaagttgcctgcattacttctgttcccatcccattggccagaaccttgtcatgtggccacgcctagttgcaaagaaagctgggaaatgtattatttaattgggcagctctgtgcttccttttagtcacatcccccaagggcaacgctatcttgattactcaccatgacatgcgttttacatttacacaaatagcctcctgttacagagttctttggtttttgttttcactctgttttgaagatctcaacacgggtctctgtaaatatctagtccatttcttcggcttccccatcttctgtgcattcaccacattttaccaaagtactctcctagcaatggcccccatatggccgcctccacacacatcactgcctcttctccccaggaaggagatgccggggcataggctatgtgggtgcaaaacactgccaggttgctctcccacatagcagctgccagcccacactcctgccaggtgcatgtgggggttctatagtcccataaaaggtattttattcatttttgtcatgtctatagttggacatctgttgttttttgcatggccagcatccattcttctttttttggtcactgtgccctagcattcttttgggaaactaccttttccgtcattctcaatccacgtgattcagatgggactgaatctcttacttactggtgtgaccaggtgatgacacactggccaacaaccatctagcacctcccaatcaatccagtgaaggcatgtgactcaaactgaatcaaattagagccaggtcaggactctcactggaactgttgggaaaagggctttccctttctctgtgggtggttaagctagagtgggtagaggccaagactgctatgatctcagggtagaagctacctgagggtgaagcaggcctccacagaagaaagtatagctgagagatgaagagtgagggtaattctcatactgtgagaaccaaccatgcctgaaggcgacttgcactagagcttttataagttacataagtttcatagagttacataagccaataaattccttatttatttattgagacagagtctcattctgtcgtttacactggagtgcagtggtacaatctcagctcactgcaacttctgcctcccaggttcaagtgattctcctacctcagcctcccaagtagctgggattacaggtgtgtaccaccatgtccagataatttttttattttcagtagagacggggtttcgccacgttggccaggctggtctcacactcctggcctcaagtgatccacctgcctcggcctcccaaagtgctggatcacaggcgtgagccaccatacccagccaaattcttttttacacaagccaatttgagttgggcttaggtcactcaaaagaagtcagactaaccccacccatcctggtgctaggcatacagtaggtcataggacaaatgtttgttttttctttttttggtaaagaaaggcagacttattagagaaagtatgaagatacactgcatgaaagcaaagggcagcacagcagagaaggggctgtctgcaaatgtttgttgaatgaatgaatgagcccatgtgtgggaataaatgagacatgacagacagctacccagtgatgtgtaaatatccacagtgagttatccaggagttcaggtgaggagcacaggcttacttattttgctaaatatgaattctaaggctaaacaagacacatgtgagctcattcactcattgcactccagttttgttccttttgctttcagataatcagatcacgacaggcgccggccatcacacctggcttattcttgtatttttagtagagataaggtttcatcatgttggccaggctggtctcgaactcctgaccttaggtgatctgcctgcctcggcctccctaaagtgttaggattacaggtgtgagccaccacgcctggctctaaaagggtatcttttttttttgaggtggagttttgctgttgtcacccaggctggagtgcaatggcatgatttcagctcactgcaacttccacctgccaggttcaagtgattctcctgcctcagcctctcgagtagctggaactacaggcacacgccaccacgcctggctaatttttgtgtttttagtagagacaaggtttcaatgtgttggccaggctgatcttgaactcctgacttcaagtaacctggctgtctcggcctcccaaagtgctgggattacagacgtgaaccactgcacccagccaagagggtatcttaagaccccactacattccccctagaggaatagagactagataggcaccacaggaccctctattctgcaattttctaggtatgttttattttgagctgatttttatgaaaagtgagtactgagaaatcctgagtgtggatattaatcccatacatcttacaatgatttaaattaaaattaaatttgaatttttttggtcttttacttgagtatttgtaaaaagtaataaatgtatttcattttaaaattaccagtgttcagtccaggtgcagtggctcacacctgtaatcccagcactttgggtggccgaggcaggaggatcacttgaggtcaggagttcgagaccagcctgaccaacatggcaaaaccccatctctactaaaaatacaaaaattagccgggtgtggtggcacacacctagttcctgctcctcgggaggctaagtcatgagaattgcttgaacccaggaggtggagattgcagtgagccgagatcataccactgcactccagcctaggcaacacagtaagactctatctcaaaataaataaataaataaataaatgtaaataaaattaccagagttcaagcacaacacaggacatgtgtgacaggcctgtgtcctttgcatctcttacctgtgatttgctttttttttgagatggagttttgctcttgtcacttaggctggagtgcaatggcgagatcttggctcactgcaacctctgcctcctgggttcaagtgattctcctgcctcagcgtcctgagtagctgggattacaggcacctgccatcacgcccagctaatttttttatttttagtagaggcggggtttcaccatgttggccaggctggtcttgaactcctgacctcaggtgatccgcctgcctcggcctcccaaagttctgggattacaggtgtgagccactgtgcctggcctctgtgatttgcttttgtattgagatacagtctcattttgtcacccaggctggagtttgtggcatgatcatggctcactgcagcctcaacctcccaggctcaagcaatccttcaacctcagcctcccaagtaggtgggactacaggtgcctgccactacacctggctaattcttgtattttttgtagaggcaaggtttcaccatgttgcccaggctgctgtgattagtttttgtttttgagatggagttttcctcttgttgcccaggctggagtgcaatggcacgatctcggcttaccgcaatctctgtctcccgggttcaagtgattctcctgcctaagcctcccgagtagctgggattacaggcatgtgccaccacacctggctaattttgtatttttagtagagacggggtttctccatgttggtcaggctggtctcaaactcccgacctcaggtgatccgcccgcctcagcctcccaaagtgctgggattacaggtgtgagccaccacacccggactgatttgtttggttggttggtttttttggagatggagtctcactctgtcgcccaggctggggtgaaatggcgcaatctcggctcactgcaacctccacctgccgggttcaagcaattctcctgtctcagcctccctgtagctgggattacaggcgtgcaccaccacacccggctaattttttgtctttttagtagagacgaggcttcaccatgttggtcaggctggtcttgaactcctgatctcagatgatctacccgccttggcctcccaaagtgctgggattacaggtgtgagccaccgcgcctgtagatttgttttttatctatttttcaactttgaatttccaattcattaaaaaagaaatcctgggggtgccaactctctaggagcttaataatatttcacttcgggcctggcgaggtggctcacacatggaatcgcagcacttgggaggctgaggcaagaggatcccttgagcccaggagctcgagactagcctgggcaacatagcaaaacgctgtctctacaaaatatgaaaaattagcagggtgtgatggcacgcacctgtactcccagttactcgggaggctgaggtgggaggatcacttgagcctgggaagtggaggcttcggtgagctgtgatctcaccactgccctcagcctgagtggcagagggagatcctgtttcaaaaaaaaaaacaagatttcacttgaggaacggacttttgaattcccaagctaaaagaaatcataagtataattataattatggcatattagtgttgcacctaagtagcataagaaatgaatcaggaactttttgggctttgggctttaaatagcagaaaccatgatttagaatggcttacatggccaggcacagtggctcatgcctgtaatcccagcactttgggaagccgaggcaggagaactgcttgagcccaggagtttgagaagagcctgggcaacatggcaagaccacactctacaaaaaataaattagctgggtgtggtggtgcatgcctgtggtctcagctaatcgagaggctgagtgggaaggatcactggagcccaggaggtcaaggctacagtgagccacgttcacaccactgcattccagcccaacacagggcatgtatgacaggccagcaacctttgcatctctgacctgtgattcacttttgtctcataaaaacaaaaacaaaacaaaacaaacaaacaaacaaaacagaagaaaggaaaaaaagagtggcttacattttttttccccaaaaatctggaggtaagtatctgctgtcgctggcggaacaataccagtgctggctattctgtgatcatcttggcttttcttcttggtaaacaagatggctgctgcagctccaggtatcatgtgagtattcaaagcaggaagaggcaggaaaagggctggagccagttgtgtctctcccttttatctggaaagcaaacatttcttggaaatccaacagcagagttggcaactgcagttgcaaaggaacctgggagaacaaatgtgaagctttccagcttctaaaataggaagaagaatggctgggcatggtggctcacgcctgtaatcccagcactttgggagaccaagacgggtggatcacctgagatcaggagtttgagaccagcctggccaacatggtgaaaccccgtctctactgaaaatacaaaattagccaggcgcggtggcctgtatcccaggtgcatgcctgtaatccctgctactcgggaagctgagacaggagaatcgcttgaatctgggaggtggaggttgcagtgagccgagatcatgccattgcactccagcctgggcaacaacaacgaaagttcgtctcaaaaaataaataaaaaaaaataggaagaagaaaagagtcacaggttagggatggtagttggcgtagctagtaggctgtatctgtcacaagaaagatcacagaagccacagtgttctagaatattgaaatctcttgtcctcctttcagttcttgtccctgaatgacagacaccgccagaactcacttcaggtctatatgcatccaggggcgacttaatagtaattcactatgtgagttattaacggttattaaaatgcagcatttgtgaactaaaattagccaatttatccatgcctgtattctgccaagtccttctggctgccactcaatgcttaatgaccttgcctttgcacaaacagctgaagtgggtatggggtttccttttgaggtgatagaaatgttttagaactagatagaggcggtggttacacagcattgtgaatgtggtaaataccactttggttaattttcccttatgtgaacttcaccttaatttaaatgaaggagaagggaaaggaagagggagagggggaggagacacagaaggcagaggaagggaaggagagaaagaaaaacaaagaaccttaacagttatttctggtggccataaggaaaaaaactctaatacttttttttttttcagacctgagttttgctcttgttgcccaagctggaatgcaatggcgccatctcggctcattgcaacctctgcctgctgggttcaagcaattctcctgcctcagtctcccgagtagctgggattacaggtgcccaccaccatgcccagctaattttttgtatttttagtagagatgaggtttcactacattggccaggctggtctcaaactcctgagctcaggtgatccacccaccttagcctcccaaagtgctgggattacaggcgtgagccacctcgcctggctctacgtcattgtgctttttttttttttttttgagacattgtttctctcttgttgcctaggctggagtgcaatggtgccatctctgctcactgcaacctctgccttccaggttcaagtgattctcctgcctcagcctcccgagtagctgggattacaggcatgcgccaccgcacgtggctaattttttgtatttttagtagggaccaggcttcagcatgttggccaggctggtgtcaaactcctgaccttatgtgatccacccgcctcggcctcccaaagtgctggggttacaggcgtgagccaccgcgcccggcaaccctaatacattattgttacagcctttgggcaaggccttttaacatttccatgggataagttccactcttgggaactaatatgtaagaatatatgtgcaagaagatgtgtgcaatattgttcatcttggcaaaaatggcaaacaaagtaaatatccatccttacagagtttctgaatagatcacggtatagccacaccacagaatattgtacagccactaaaatgctctttgccaggtggcctggagggatgtcaatgtgatgtgttaaatgagaaaaggaggatacagaaaaatgagtataacatgatgctatttatataaactcctgtgtattcaatgtgtatgtagtatgtttgcatgtctatacttacatatacatgtacgtgtatccaaatatgtatgtatatgtgtatttgttttttttgttgttgttcgtttgtttttccagatatagtcttgctttgttgcccaggctggagtgcagtggcgcaatctcagctcactgcaacttcacctcctggttcaagcaattctcatgcctcagcctcctgagtagctgggattacaggagcccaccacacctggctaatttttgtatttttagtagagacggggtttcaccatgttggccagactgttctcaaactcctgacctcaagtgatccgcctgcctcggcttcccaaagtgctggggttaaaggtatgagcccccgagcctggctgtatatgtgtatttgtataaaattacctaggcatggagaaaaagatgggagcatacaaacccgaggtgagaacgggagagaaaaaggagaaatagggaaggagaagccaagagaaaaaagaaagagaaaaaccaaaaagatttctctagaagaaacttcctggccgggcatgttggctcacgcctgtaatcccagcactttgggaggccaagggcaggggtggattaccagaggtcaggagttcgagactagcctggctaacatggtgaaaccccgtctctactaaaaatgtaaaaattagctgggcgtggtggtgaggccctgtaatcccagctactcgggaggttgaagcaggagaatcacttgaaactgggaggtggaggttgcggtgagctgagattgtgccattgcactccagactgggcgacaagagcaaaactccatctcacaaaacaaaaaacaaaaaacaaaaactttctttcccccaacatatatgatatgatcacatttatgattttttgtaaaattatatgcgtgtgcatgtacatgtataaaaccgttaaatcatagatttaatgcattataatcaaacagaatttaacacagaattagacttactgttattatggcaccatcattattaattatgcctgcaatgcctcctttatgcagagagtaacaatgcatatttgcatgaacagtatttctggtgtataattttccaattatctggtattagaatatgcacgtattatgaatcaaatatgaattatttagactcttcccccgaaatatatccagagtcctggaagttaatttatgtggttgaataattaatataagtgattatagcaccccgcccccttaaagaaaagaccatttggtctttgcctgcccagcaactgaggcccttggaggagactctgcctttgcccaatagtttccctggatttttgtaatgggaagaatgaaacaggagccagacagagagggagctatggagtagatcagtagagcttttcctgctgagcagactcttgccaatcactttcgttcttctactccagatctggatctctcaacgcttgatgtgaacatgtgacccagacctagccaatcggagggcttcatccatctggccaatgtgattggtcagatctgggcacatgacccaaactgggccaatcagaggattcatttcctaccacttcctgctgaaactgtcagagacacgcctttcttgagactgctggcccctctcaccacactgagagtgaagcctcacagaagacgctgacagcatgaaggactagaagattctgaagacatctttgagcacctggctccaactgtgctaggatcttaggatctgggtatatttaaagtgcacaatgtcttttattttattttttttttgagacggagtctcaatctgtcgcccaggctggagtgtagtggcgcaatctcggctcactgcaagctccacctcccaggttcacgccattcccatgcctcagcctccccagtagctgggactacaggcgcttgccaccacgcccagctaatttttttgtatttttttagtagagacggggtttcaccatgttaacaaggatggtctccatctcctgacctcgtgatccgcccgccttggcttcccaaagtgctgggattacagggcgtgagccactgcacccggccttttttttttttttgagacagtctctctcgcccaggctggagtgcaatggtgcgatcttggctcactgaaacctccaccacctgggttcaagagattctcctgcctcagcctcccgagtagctgagattaaaggtgcgcaccaccatgtccggctaattttagtattttttgtagagaagagttttcgccattttgcccaggctggtcttgaactactggggtcaagtggtcttcctgcctctgcctcccaaagcgctaggactgcaggcatgagccaacacgactggctgtgttcatgagctaatattgtctcttctggtttctgtttgatttccagattaatggtatatccatcaagagtagtattcttggccgggggctgtggctcacacctgtaatcccaacattttgggaggcctaattgggagaatcacttgagcccaggagtttgagaccatcctgggcaacgtagagagaccgcatctccaccaaaaaaaaaaaaaaaaaaaaaaatgctgggcgtggtggctcacgcctgtaatcccagcactttgggaggctgaggtgggaggatcacttgaggtcaggagttcgattcgagaacggcctggccactatggtgaaaccccgtctctactaaaaatacaaaaattcgccgggtgtggtggcaggtgcctgtaatcccagctgctcgggaagctgaggcaggagaatcgcttgaacccgagaggtggagtttgcagtgagccgagatcgcggcattgcacttcagcttgggcgacagagccagactccgtctaaaaaaaaaaagaagccaggcgtggtggtgcgtgcttgtggttccagctactcagaacactgaggtgggaggattgcttgggcccaggaggtcgaggctgcagtgagctgtgattgcaccactgcactccaggctgggtgacagaataagaccttgtctcaaaaagaaaaaaaaaagcaagattcttgggttctgttctttctcatttgttctttctttcttttttttttttttttttgaggtggagtcttgctctgtctcccaggctggagtgcagtggtgcaatctcggctcactgcaagctccgcccgccgggttcacgccattcccctgcctcagcctcccgagtagctgggactacagcgcccgccaccacgcctggctgattttttgtatttttagtagagacggggtttcactgtgttagccaggatggtctcgatcccctgacctcgcgatccacccgcctcggcctcccaaagtgctgggattacaggtgtgagccactgcgcctggccttgttctttcattaaatttttcctcaacactatgtgccaagcctttctgaggctctgagggtacaaggatgaatcaaactgagtattatggcagagacagctgtttcagcactaatatctcttttttccccttctttctttaataacagaagttatgagttttaggtgggtgcatgtttatccagttgatgactacatttctctttttttgttttgagacggcgtctcactctgttgtccaggctggagtgcagtggcacaatcttggctcactgcaacttccacctcccgggtcagtgattctcctgcctcaggctcccgagtagctgggactacaggtgccggccactgcgcccggctaatttttgtatttttagtagagatggggtttcaccacgtgggccaggttggtctccagctcctgacctcaggtgatctgcccaccttgacctcccaaagtgccaggattacaggggtgagccaccatggccggcccccgatgactacatttccttttttttttcttttctttttttttttttttgagacagagtctaggtctgccacccaggctggagtgcagtggcgtgatcttggctcactgcaactcctgggttcaagcaattctcttgcctcagcctcctgagtagctgggattacaggcacccaacaacaccatgcctggatatttttgtatttttagtagagacaggttttcaccatgttggccaggctggtcttgaactcctgacctcaggtgatctgcctgcctcggcctcccaaagtgctgaggttacaggtgtgagctgctgtgcctggcctgatgactacatttctcagcctgctttggatctaagtgttgatgtgactgagttctggtcagtgagatataagcaacaatgataaatgttccttctaggtcatgctatttttttttgctctgacacactttatcatcacttaatgggtcatgctattaaaaggaatggatatgttctccctttgcccctttttctgccattttccactggccaggatgcaggtgtgatggcaggacctagagcaggtacctcgacccagagattgaagctgtgtgttgaagctggccattgcctccctgctaccctaggacctcctaacttgggttgttagtgagagagatatatacttgattttgtttaagccactaaacttaatgtctctttgttatagcagcctagattttacccaaactaataagcctttgacctccacttctagtgaaatagaccaaagagacagccaccccctgccccccgcaaaaaagtgacaagttctgaaatagatataaccccatggtgttgtgaggttataaattagggcatgcgtggctgggcgcagtggctcacgcctgtaaccccagcactttgggaggctgaggcaggcggatcacctgaggttgagagttcgagaccagcctgaccaacatggagaaaccctgtctctactgaaaatacaaaattagctgggcatggtgatgcatgcctgtaatgccagctactcggaaggctgaggcaggagaatcacttgaacctgggaggcaggggttgcggtgagccgagatcacgccactgtactccagcctgggcaacaaaagcgaaactccgtctcaaaaaaaaagttagggcatgctcaacttgggctgagacactgtttgatgaaaggcttactgaggaggatggctgaaaagaattcccataagcagaaattggagtagggctggacgtttgaatcaattaaaaatgttttgagctgtgagcagtggctcacacctgtaatcccagcactttgggaggctgagtcaggaggatcacttgagtccagcaggtcaaggctgcagtgagccatgatcaggccactgcactgcagccttagtgacacagcaagatacacacacacacacacacacacacacacacacacacacacacacacacacggtgttttggctataagtaacaagaataacaaaatacaacaaggaatatctttaaggagtcattcatttattctacaaacattttcctgtcacttactatattccaggtcctgttctaggtgctggggatatggcaatgaataaaacagatcaaccccctcaccactcctgaaaatccaagaaaaactctggctttatagattttatgatctgtggggagagatttattatcttacagaacaagaaatccagagataggtggtcctgggctggtggatagaggctcaacactatcttaaaggaccttattctttccatctcttcactctgccatcctcagtgtgtcggcttttttctcaaccttgtaacctcatagttgtaatatggctgccactgctccaggaggcacatcacatacacattaatccagtggagtagaagaagagaacctgtttcctcccatgctgctcttcttttttatttttctagcaggaaaacttcctcggaagtcttcagctaactttaaatcttatttactagaattgcatcacattcctaataaaatcactggcaagtcgaaggaaacaagcatgagtggcttaggtcagtgttctcaaatggttgtctcaggaccaggcacggtggctcatgcctgtaatcccagcactttgggaggccaaggtgggtggatcacctgaggtcgggagtttgagaccagcctggctaacatggtgaaaccctatctctgctaaaaatacaattagctgggcgtgttggcacgcacctgtaatcccagctactcgggcagctaaggcgggagaatcgcttgaacctgggaggcggaggttgcagtgagccgagatcatgccactgcactccagcctgggtgacaaagtgagactccgtctcaaaacaaaacaaaacaaaacaaaatgagacaaaaaagctgttgtcaggttattaatgactccaaagagctttggtttatgtggttatgtctattgatatttgctatattagaagttaaaagtgaaaaaaattaaacatgtatttattcattcaaaattatcctttacatagtaacataaataattttttatgaaaaatagctatactttgcaagacaaaaaatagtgcaaagcatggcattttttgtttgtttctttgtttgtttgttttagacaggttcttgctctgtttcccaggctagagtgcagtgatgcaatcatagctccctgcagcctcgacctcctgggctgaagcgaccctccttcctcagcatcctgagtaccaggaagcacaggcttgcagcaccacatccagctaattacttcataatttttatagagacaaggtccttctgtgttccccaggctggtcttgaactccgggactcaagcgatcctctggccttggcctccaagtggcaaagtggccctgttttgcattttgctattatctctttgatgtctgcttaacagaagaagctggattttcatgcctgcttctgcattcaacccattgtgatattctgttttgctttaaatacacagaaattctggtctcatacatgtatgttgttgcaaaaaagaaggctttgtggacctcttggaaaggtcttgaggattcagcattcacaactggagaaccactgacttatattgattaaaactcactctctgaggatcccttgagcccagaagtttgagacctgagcaacatattgagactccgtctctaaaatataaaaataggccaagtgtagtggttcatgcctgtaatcccagcactttgggaggccgaggcaggtggatcacttgagggcaggaattcgagaccagcctggccaacatggtgaaatcctgtctctactaaaaatagcaaaattagttgggcatggtggcgcacacctgtaattccaactacttgggtggctgagacaggagaattgcttgaacctggaggtggaggttcagtgagccaagattgtaccactgcactccagcctgggcgacagtgcgagactccatctcaaaaaaataaaataaataaaaatttaaaaaattacctggatgtggtggtggtgtgcacttgtagtcctagctgcttgggaggctgaggtgggaggatcatttgagcccaggaggtggaggctgtggtgagctatgatcgtgccactgcactccatcctgggagacacagcaagaccctgtctcaaaacaacaacaacaacaacagcactcactccctgggctataaagaggcttagcccccacccataattccacacagctcaacctccctataaacacatggctgcttccattccttaacaaaatcataattctctcagcaaggagaaaggcagggaggggtattggacaaaatcataattctctcagcaaggagaaaggcagggagggttattgggtgggcagcccacagagtctgccacggattgctctacagcggaggttttccagcctattcgaccgtgtcccacagtaacaaatacattttacatggtgactcagtacacacatgcacacaacagaaacatttttattaacaatacttaggcttgcaacatggaatgccctctgatattttctattctttgtattcttttctatttctttttttaaaaagtgctggctgtaacccaataaattcacttcatgattcactagtgggtcataatcttcagtgtgaaaaatactgttctctagggacttgttatttgattggatagaggggctagacagaggccttcaaaggagggaattcataaccattgcctcaaaagttggccaaggaattgccccaagatgcctgtgttgacccagcctttgtcctttttgcctgcattaactcttttatattgagcagagggcaagtaggctcaactcaaatggtgttaagtaaaaaggtaaggctgggcgcagtggctcacaccgcggcactttgggaggccgaggcaggcggatcacctgaggttagtctggccaacatggtgaaaccccatctctactaaaaatacaaaaattagccaggcatggtggtacgcgcctgtagttccagctactcgggaggctgaggcagggagaaacccttgaacccgggaggcggaggttgcagtgaacggagattgcaccactcacttcagcctgggtgacaaaaaaaagtctcaaaaaaaaaaaaaaagtaaaaagataaacagaattataattataacaaaatttattgactcatagaattggaaatcccaggagcctcgtgagcttcaggcacagccagaatgatggccacagggtaagtacttgttgatctccccctggagaccctcatgtcctccatgttggcttctcaggaggagaatctcaggcaatagtgccccctgtagctccccaacttcaaaaaccagagtatagaaaactacatcttactggcaggtctagaaaaatgtcgccaaacctggatcatgcatccacctttttttgtttgttggtttttgagacagtctcgctctgttgcccaggctggagtgcaatggcacgatctcagctcactgcaacctccacctcctgggttcaagcgattctcctgcctcaccctcctgaatagctgggattacaggtgtgcaccaccatgcctggctaatttttgtatttttagtagagacagggtttcactatgttggccaggctggtcttgaacccctgacctggtgattcacctgcctcggcctcccaaagtgctgggatcacaggcatgagccaccgcacctggcctatgcatccaccttttgaagggaatgttgaggtcagccttctctgaacacgtggggtgagagtggatgggcagtggctttccagtggagaggaggaagttgttgcttgaagcagggaggattttgagcaggcaaaaccagcagatgtttactacctcaagctccatgaggccagggaaggtgctgggtcctgagcaccactgtatgcccaatgactggcacaaattagactcagaaaatacttgtatgaacaagggcaattgtgttgtatgattgggtatccatggacaatttacatatttgaaaaggtaacagaaagatttgtagggcatgatggctcatgcctgtaatcccaggactttgtgaggctgaggtgggaggattgcttgagcccaggagttcaagaccggcttgggtagcacaacaagatgccatctctacaaaaaattagctgggtgtggtggcatgtacctgtggtcccagctacgtgaggggctgaggcaggaggattgcttgagcacaagaggtcaaggctgcagtgtgctataatcctaccactgcactccagcctgggcaacagagaaagaccacatctcaaaataaaaaaacaaaataaagaaggatagacaaataggttagtggaagagaatagaaagtccagctagctgggtgcggtggctcacgcctgtaatcctagcactttgggaggccgaggcgggcggatcacaaggtcaggagatcgagaccatcctggctaacaccgtgaaaccctgtctctactaaaaaaatacaaaaaattagccgggcgtggtgacgggcgcctgtagtcccatctacttgggaggctgaggcagaagaatggtgtgaacctgggaggtggagcttgcagtgagtggagatgcgccactgcactccagcctgggagacagatcaagactccgtctcaaaaaaaaaaaaaaaagaaagaaaaagaaagcccagctgagactgacacatatatggccaaattatcttcaacaaagtcaccagggtaattcattgaagaaaatcaattttgtatttcaacaaatattactgggacaggccaggtgcagtggctcatgcctataatcccagcactttgggaggctgaggcagaaggatcacttgaggccaggagtttgagcagcctgggcaacaaagggaaacctcgcctctgtctaaataaataaataaataaaattcactgttgagaaaaagaaaaggccactgaattgtatactttatttcattttatttatttatttttgagactgagtctcgctctgtcacccaggctagagtgcagtctcatgatctcagctcactgcaacctccgcctcccttcaagcgattctcctgcctcagcctactgagtagctggaattacagacatgcaccaccatgcccagctaatttttgttatttttagtagagatggggtttcaccatgttggtcaggctggtctcctgacctcgtgatctgcccaccttggcctcccaaagtgctgggattacaggtgtgagccactgtgcccggcctgaattgtatactttcaaatggtttggccgggtgctgtggctcaacgcctgtaatcccagcactttgggaggctgaggcaggtggatcatttgaggtcaggagtttgagaccagcctgactaacatggtgaaaccccatctctactaaaaatacaaaaaaaaaaaagaagataaagaaagaaagaaaaagaaagtagctgggtgtggtggcatagtcccagctacttggtggctgagatgggataatcacttgaacccgggaggtggaagctgcagtgagccgggattgtgccactgcactccagcctgggcaacaagagtgaaactccgtctccccaccaaaaaaaccccaaaaaacattatatcttcctggctaagtgattggcttatggtaactcagactgagccaacgaagccctcctcagtttgttcttggaactattgtcaggggtattttccctttccattggtgttgctgtgctggtgagaaataaccccagaaccagcaggtaggcaaagctacaggagaggaaagccaacttggagaagaaccgagagatgatagagaaatggaaaccagccatgttgagcccctgggttcaggttcacctgatgtcctccaaactttttgttcaggctagtttaggatgtgcctatatttcttgcaaatgagtctccaaatacaaaccccaaatcattgtagcaaaatgcactgaccaactgtgcttccacgatcagatcagtaagctgggtgcagtggctcatgcctgtaatcccagcactttgggaggccaaggtgggcggatcacttgaggtcaggagttggagaacagcctggccaacatggtgaaaccccatctctactaaaaatacaaaaattggccaggtgtagtggcaggcacctgtaatcccagctacttgagaggctgaggcagaagaatcacttgaacctcggaggcagaggttgcagtgagctgatatcatgccactgcacttcagcctgggcgacagagcaagactccgtcccaaaacaaacaaacaaacaaacaaacaaacaaacaaaaaccaatgtgtaagtgaacagagagaacaagaagtttaaggaaaattaaaaacataaaggacaaagtgagagaagagaatatctgtaaaatacatgaatacacacacacagtagatgtttcatggttgtttatcccccacctctcgctggaacacagactggtgccccacttcgtgcttgggatgtccttcctctgtttcttggctgagtcgaacttgtgctgcttcctttctccttaaatatcctttcctctggacaggatgttcctgaaggaggccacaaggcagaacatctcggctaactttagtttgctattttcagcctgaatttgtgcctgggcaaatcagtccacggacagagtatcctccccagttggatatttcttgcatgagcatcagaattttgtgggacacaaggcttagtttcactaagctctgagcctcaaaacctggtatgcatctgggttagagagcctcatccagtcttttttttttttttttttttttgagatggagtctcactctgtcgcccaggctggagtgcagtggcgtgatctcagctcactgcaagctctgcctcccgggttcatgccattctcttgcctcaacctcccgagtagctaggactacaggcacccaccaccacacccggctaattttttgtatttttttttagtagagacggggtttcaccgtgttagccaggatggtcttgatctcctgaccttgtgatccgcccgcctcggcctcccaaagtgctgggattacaggcgtgagccaccgcgcctggccctcatccagtcttaaaaaaaaattccctgagctgtagaatatatggtggacatattttctgcattccttttttgatgtaggtaggaaaaaaacccaaaaaaccccaaatcacaattgtccctccagggaactgagaagctggggtacttacccattgactcctgtattccattggttaagaaaagcttctggtggctttaagtccctaacacttttttggggctgtcttgcatcctgtgctggagacagctcttaggttaagagacacaggtgttcagcctgggcaacataaggcgacactgtctctgccaaaaaataaaaaaaataaaaaaataaaagccagggggtggtgcgtgcacctgtggtcccagcaactcaggaggctgaagtgagaaaattgctcgagtctaggaggttgaggctgcagtgagctgtgatcatgccactgccagcagcctgggcaacagagcaagactttgcctcaagagaaaagaaaaacagtcagatgcggtggctcatgcctgtaaacccagcactttgggaggctgaggcaagtggattacttgaggtcaggagttcaagaccaggctggccaacatggcaaaaccccatctctactaaaaatacaaaaattagctgggcgtggtggcttgcacctgtaatctcagctacttgggaggctgagttaggagaatcacttgaacctgggaggtggaggtgtcagtgagccgagatcaccccactgccctccagcctatgcaacagaatgagactccatctcaaaataataaaaaagagactagtgtgggaggatcacctgagcccaggaggcggaagttgcagtgagctgagatcacgccactacagtttagcttgggtgacagagtgagactctctcaaaaaagaagaagaagaagaagagaaacagatgtgtgtgtgaggtgggagctgccagcctgtccatcatagttgtagctaatctcagaagcaggccaaggggatttgctatagggcaccagcagtatatgctagaaagagaatgtagtacatgtactggcttgtagcacaggggacattctagttttaggcaatgctgaatcaagggcctcaaataatgtcaacaggacttgaactttcaccatcttttagttccttacaccttatatcctctattagtggcttctcacaactgtgggcttaatcctaccagtccaggagccccagtagaacagagcatcctttctaacacctgagctgactttcatggtcttgcttgagttctgtgcccagtcctgctctacggccaggaagctgtggccctctgattgaccagatctgagctaaacgcagtggtgtgttgataaatgtctaacaatagtctttttgagaaaataaaagttttgatttgtagtgtttcctgatttctatgatgtaagtacccccattagcttgaaaccatagccgatttcaattaccaatgtagtgtcaaccggtttacagaactcttgtcatgtcccatcagctctagtgagctagttcgagccagctcaaacacaatgctggctcatgtgtctcctgttgaacagaggcagttgaggcaccccatgcattccacagggactgaaggtggggaagggaaatcgggtgctgttgtcacgatttggggggcgaatagttgctgaatgggaaaaaccaggtctccatcaatcatacagacagacagagatcctgtctccaaaaaaaaaaaaacaaacccaaaaaactgcaacaaacatcttggtaaatatatccttataatataaaattatatatcctttgtttgtttgtttgcttgtttgttttgagacagggttctcgctctgtcactcaggctggagtgcagtggtgtaaactcagctcactgcaacctctaccttcccggcctctacctccctcactataacctcaacctcacacctcagcctcctgagtagttggtaacataggcatacaccaccatgcctggctaattttttgtatttttggtagagagagggtttcaccatgttgcccaagctggtctcgaactcctgagttcaagcgatccaccaccttggactcccaaagtgctgggattataggtgtgagccaccatgcccggccaccttatatatccttatatgttgtcttttctataacactggtcagcaaaccaaggcccacagaaaaccaaacccagtctggcacctgtttttgtttttgtttgtttgtttgtttgtttgtttgtttatttatttatttatttatttattttagatggagtctccctctgttgcccaggcttgagtgcagtggtgtgatcttggctcactgcaacctctgcctcccaggttcaagtgattctcctgtctcggcctctcgagtagctgggactacaggcacgccccaccatgcccggctaatttttatatttttagtagagacggggttttaccatgttgcctaggctggtcttgaactcctgacctcagatgatccacccgcctcggcctcccaaagtgctgggattacgggcatgaaccaccttgcctggcctggcacctgttttgtaaacaaagttttgcaggaacacagcaaactcattcatttacataatgtctgtagctgcttttgcagtaccccagctgaatggagtcattcagagactgcatggcccagaaagcctaaaatatttactctctggcaccctttacagagaaagtttgttaacctctgctctataatataggacctacattatggaaagggaaaaagatatatgttttaaaaaatttaacagacagccggatacagtggctcacatctgtaatcccagcactttgggaggccaaggcgggtggatcacctgaggtcaggagttcaagaccagcctgaccaacatggcgaaaccccgtctctaataaaaatacaaaaattagcaacgcatggtggcacacacttacaatctcagcttctcaggaggctgaggcaggagaatagcttgaacctgggaggtggagcttgcagcgagccaagatcacaccactgcacttcagcctgggtgacagagcaaaactttgtctcaaaaaaaaaaaaaaaagaagtgtacaaagaagaaagcccactcttctatcgcaattaccagtttggtgtaatagtccaatcaacacaataatcaatacacacacacacagttttgtcctttcttaaaacaaaaacaaaaacaaaaacaaaaaaacaggaatggatcagtaatttcctgtagctattatccccgaaatacttttgtattattctgcccgttttctgatagctcataatcaaagaaagatcactgcaggtgtttggacacaaaaatcctagcagctggtgcccctcgcagcagaatttcaacctgacacactgggagccagaatgtttgttggctctgataagctaataaccacatgtttcaatgtcccgtgtccctgaagaagccattttcatgtgactttcctgcttcagaccaggcccagttcactgagttaaaaaccaaaatgctcatcgtggcctacaagttcctccgtgacctggcctgtagccagttttctggtaccgctcttccccttggtctctgtgccttctttcacttcctccaagttgcaccaagccctttccggcctcggactgggttagtcagaactctttcagtttcaagtgacagaaacccaactcgaactggactaagcctttagagtgtattaggctcatacaaccgaaaagtcccaagaaggccgggcgtggtggctcacgcctgtaatcccagcactttgggaggctgaggtgggcggatcacctgaggtcaggttcgagaccagcctggctaacatggtgaaacccccgtctctactaaaaatacaaaaattagccaggcatggtggtgtgcgtctgtaatcccagctactcgggagactgaggcaggagaattgcttgaacctgggaggcggaggttgcggtgagccgagatcgcgccattgcactccagcctgggcaacaagagtgaaactctgtgaaaggaaggaaggaagggaggaaggaagggagggaggaaggaaggaatgaaggaggaaggaggaaggaggaaggaggaaggaggaaggaaggaaggaaagaaagaaagaaagaaagaaagaaagaaagaaagaaagaaagaaaagaaaaggaaagaaaagaaaagaaaagaaagaaagaaaggacggacccaagaaggtggattcagacatagatggctctagtctcccttggctgcccctagtctccactgcattatcttcattctcagtctctcccaaagggatggaaggatggtcctaaggttgcagcctaattagccatccaggtggaaagaggactctcatttcctctttattgctctagaaaaaggtcctgtgggccaggtgcaatggctcatgcctgtaatcccaacactttgggaggccaagttgggcggatcacgaggtcaagagattgagaccatctggccaacatggtgaaaccctgtctctactaaaaacacaaaaattagctgggtgtggtggtgcaaacttgtagtcccagctacttgggaggctgaggcaggagaatcgcttgaacccaggaggcagaggttgcagtgagctgagactgcgccactgcactccagcctgggctgcagggcgagactattctgtctcaaaaaaaaaaaaaagaagaaggccctgtggataaggctcattgaatcagctggcgtgacacaaccatccctgaaccaatcgctgtgatcagtagggtaggcttcactgatcagtcagccttgggtcttgtgcctcacaccctcccaccagcactggtgggggaatctgccccatctgaaacatgaacactggcaatcaagaagggaaatagccgcaggcaggcaaaaacaacaggtgtccacggcaagcctctgttcatatcctcccctctgcctggagcacccttcacccacttttcactgtgacagcaaggttatttttcacagctttggtagagcaggcaaaagattagaagtggcacagctgcctattaataagaaattgcactttgggaggctgaggtgggaggatccctcgagcccaggagtttgaggccagcttgagcaacacagtgagaccccatctctacaaaaaataaataaactagccaggtgtagtggtcctgtagtcccagctacttggaagcctgaggtgggaggattgcttgaatccaggagtttgaggctgcagtgaaaccctgtctctaaaaaaaaaaagaaagaatgtagagaataaccttgcttgtgcttcagacataggcagtagaatgccgaaataggcttgtccctgctccggagagccacttcctaaaaagtcaggaatcttaagtcagttgtacactgtaggtagcttgaaattagccatggtggaagtatttacaccacagaaatgggcaaatgctgcaaaccagggctgttttgtttgtttgtttttcccttggagagcctctttatcagcacaacactgccagagaggggtttgaaaagttcctctggtcagaggtcaaagagcactgacaattagccccaagaaatcagaacagccaggtatggtggctcatgcctgtaatcccagcagtttgggaggctgaggcaggaggatcttgagctcaggatttcgagaccagcctgagcaacatggtgaaactccatctctacaaaaaatacaaaaaattagctgcgtggtggtgtgtgcccgtggttccaactacttgggtggctgaggtgggaggattgcttgaacccgggaggttgaggcttcagtgagcttagattgcgccactgcattctaagcctgggtgacagagcaagaccctgttaaaaagaaaagaaagagaaggaaggaaggagggagggagggaagaaaggaaggagggaaggaaggaaggaaggaaggagagaaagaaaggaaggcaagacaaggcttggctttgggcagaagggagaaacttattgggtcaaaggaggaacagaagtctaggtagttgacttttcttccaaagtacagatccctttgaagtaaagccaaggcactatgagggtcgtgaccctgaatcatataaggtgccggctggtctttgtttaatgctcgctgatctttgttaaatgcactggttggtaggatagtgcttttgtctagagctaaggtcaaagaatattacactaaggcaaagatttctccctacttgcagtagggatcaaataggaaaatgaatgcaaacatttggaaaagtacgaaatagcctcccaaaatattaggcaaaagttagagaaaatgatgattcatgctacaataattactacctttccaaggaaaaatcaaatcctttatgcttctggcacagtaacattgcaatgtacattaccactcactgcattgcctcaacagtcatcatttcgtgcccccaggaaaggaaagttacagtgattcggaaaagcaaaaaaaatctccacagttattgacaacagtattcatggaggttaaagaggcagtttggcctcattttattgtgaactccggttcttataacagcaagaataatcatccacttttttttttttgtaatgcacccttgatgtgaaaatccaggaaataaaatgtttccaattcaagatgttctttccatataattcccagcatcctccctcccttagccctgagaccatcagacaggaccaagaatctctccctcccttctttcttcacagataactttctcattggccagcctgccctcagcccctgcactgttaaatgctagcggcttccttcctccctccctccctccctcctttccttccttccttttttatttatttatttattttttatttatttatttttttgagctaggatctcgctctgtcacccaggctggagtgcagttgtgtgatcatggctcactgcagcctcgacctcctgggctcaaacaatcctcccctcagcctcccgagtagctgggaccacaggcatgtgccagccaccacaactggctaatttttttttttttttttttttttttgagactgggtctcgctctgtcacccgggctggagtgcaatggcacgatctcgggtcactgcaacctctgcctcccgggttcaagtgattctcctgcctcagcctcccaagtagctgggattacagatgcctgccaccacgcctggctaattttttttttttttttttgagatggagtttctctctgtcacccaggctgaaatgcagtggtacgatcttggctcactacaacctccccctcctgggttcaagcgattcttctgcctcagcctcccaagtagctgggactacaggcgcgagccaccatgcccagctaattcttgtgtttttagcagagagggggtttcaccatattggccaggctggtctcgaactcctgacctcgtgatccatccacctcagcctcccaaagtgttgagattacaggcgttgagccacagcgcctggcattttttaaaaaaatattttaagtagagacggggtttcatcatgttgaccaggctggtgtcgaactcctgacctcaggtgatccgcctgcctcggcctcccaaagtgctgggattgcaggcgtgagccaccgcgcctgaccacaactggctaattttcaaatttttaatagagacaggggtctcactatgttgtccaggctggtcttgaactcctggcctcaatcaatcctcctgcctctgcctcccaaagtggtaggattacaggcgtaagctgctgtgcccggactacctctttcttaatatgcaaattgtccccacgtagtaggggctcaaaaggaaggcggtgctggggtgaaagcaggcatcaatttaagcagttcttagactagagccataaaaccaaactacactgtctgtcatcacctgaagagaggggctgttccaggcgcagctgggaacacagcagcaaactgggtttcccaaacgtgagttaaccagcatcttacacgcgggttaaaatgtccccttacgttatgagatgtagggaaggggtggttcctgatcaagaaggccacttcaaaccagatgactttgcttgtctgcatagagcctgcactgtgcatggctgccctgtgtcacagatgggctcttgcttccttctgtcaatttcaggaaagatgtgtgctgggagacctggggcaggaagagagggatgcccctaactacattactctgtagaatcagattaagatgctcaagtagaggggcctaggagagggaaggagttcacggaagggcaagcagagaggaggaggaatgatttccagcatccccatcttccctgtccctcctgctccactgctctgagcactccctccctgcacagagggactagaaataggatctcagggctgggagagcaatggctcatgcctgtaatcccagcattttgggaggctgatgtgggaaaatcacttgagcccaggagttcgagaccagcctgggcaacacggcaaaacccccatttcattattgttattatttttaaagacagagtctcactctgttgcccaggctagaatgcagtggagtgagctcagctcactgcaacctcagcctcctgggttcaagagattctcctgcctcagcctcctgagtagctgagattacaggcacccaccaccacacccagctaatttttctattattggtagagatgggggtttcaccgtgttggccaggctggttttgaactcctgacctcaggtgatccacccacctcggcctcccaaaatgctcggattataggcgtgaaccaccgtgcccggccccaaacccccatttctacaaaaaaaaaaaaaaaaaaaaaattagccaggtgtcatggtgcatacctgtggtctcagctactcaggaggctgaggcaggaggtttggttgagcctgagaaattgaggctgcagtgagctgtgattataccattgtcctccagcctgggtaacaaagcaagaccctgtctcaaaaaaaaaaaaaaaaaaaaggatcttgggacttttcacagggcccagggcccaggcctcccatccagagagggcctcccaccaagatgtgcacatcccctctgacaggaccgagttttaaaaatcaacaacagtgttggtaaccctatttggtttttctgcttttttctttttcattaagtgagacctttaaaaaacagaagtgccttggtcttctctcaacctctgagaggccctgtgtgctgcgggcatctgcttttcagctgggaaagttcagcctcctcccactccacagcctctctctggctccaaccatcagcccccagctggggtgtcaggtgggaccttcagaaaggtggtgtcttgagttgagttcctgcagaagctgactagggacagactccgtgcaatagtggcatgagccactgtgcctggccacaaatggctttattttatgtattaaattaataattagggctgggtgcggtggctcaagtctgtaatcccaacactttgggaggctgaggtgggcggatcagttgaggtcaggagttcgagaccagactgggcaacatggtgaaaccccgtctctactaaaaatacaaaaatttggcaggcgtggtcgcgggtgcttataatcccagctactcaggaggccaaggcagagaatcacttgaacctgggaggcagaggctgcagtgagctgagattgtgccactgcacgccagcctaggcaacagagtgagactctgtctcaaaaaaaattaattaataattattaattaatttgcccaggctggagtgcagtggtgtgaatacagctcactgcagccttgaactcctgggcgcaggtaatcttcctgcctctgtctcccgagtagctgagataacagttgtaagccaccatacctggctaattattttattttttgtagagatgaggtctcactttgttgcccaggctgggcttgaactcctgggctcaagcgatctgcctgcctcagcttcccaaagtattgggatcacaggtgtgagccactgtgcctggccacaaatgactttctgagacccatctcctccccatttctaatcttaagaaaatcagaggatcaggccacattgggcccacgtccctgtcttgcaactcttggttgaactgagaagtgactgcctcttttatttatttatttatttatttgtttgtttgtttgtttgtttgttttgagacagagtctcgctctgtctcccaggctggagtgcagtggcacaatctcggctcactgcaacctccacctcccgggttcaagcaattctcctgcctcagcctcctgagcagctgggactacaggtgcgtgccaccacgcccagctaatttttgtattttcagtagagacagggtttcaccatatcggccaggctggccttgaactcctagcctcgtgatccacccacctcgcctcccaaagtgctgggattacaggcgtgagccaccgtgcccggctgtgactgcctcttttaaatagagccacgctttcctctgggtccccatttggtgcatttcacaccttttgttagttcagtgtcaatatcttgcctctagagaagtcagggaccatttctgtcttatccttctaaaaccctcctcccaccctcctagtcacttgctaccccacccacactgtctccctgtggcttgcacacgttccctttgcacctgtacttccctctgtctgcccagaacactctctttccagagttcctgctggctcacacactttctgctttggtacagatgagcattcttggaaaccaagtgttaaggacagtggagccacaagataggggttcaggaacatggatccccgaatctgtacctggtggaggaggaactccattgatcaggaactcctattgtgaaatttataggagaagaactaaatgattgcatcaaaccatcaagatttggagcttatctgtccatgaccctggcagtaccctaaatgatgaacaaggtgagtcacatttggggtggaatgcttgcaagctcgcttgtccacacaccaaaagccatattcgccagccagcattgttggggataatggtgatcatttgttctcactctgagacaagcatttgtctttcaaactattctgaattcaggtgatagaaaaggatgttgcttattacgacacttaaaattccaacaagaattaaggcctgaataataccatgggtggtattgatggtattgatggggagaagggaggaacaggttctgaaacacatataaaaaattcgatcggatggcacaattgttttccaggcaaaagagcaaaccaaactatttttaaatgtcaagagctaaatagcctggagaaaatgtaatatattacaagcagtaagcaacagacctacacataagttgatacctttcaacataacagaatggcgagtcctggcttaaccttctgcacttccaaaccggttccctcctagaattaacattttcttgtcatcttagagtaaaggctgtgcattctcagccattaagtcttccaggctgaaagctttccttaaacttgtttcaatccgtctttgattctgaaatgctccaattacatttccatagtggccatgttaattaatggtgatgatcagacttaatgaaagagggaattagtaagccattccctggccactttcataaaaagggagagtgctaacaagtgctaatggcctgacatggaaacctcaccttccccggagcttttaacctgcagtcacatcctgaaacataacccgaaggctgctctaagcaactgggtgtttgatcttcttcttgtaagcagagctacttatactcagatttctcaactgaattcatcctagaaaatagggccttcaggcctggcatggtggctcacacctgtaatcccagcactttgggacgctgaggtcgggggatcacctgaggtcaggagttcaagaccagcctggtcaacatggtaaaaccctgtctctaccaaaagtacaaaaattagccaggtgtggtgtcacatgcctgtagtcccagttacttgggagtctgaggcaggagaatcgcttggacccgggaggtagaggttggagtgagccgagatcgcaccactgcactccagcctggtaacagagtgagactctgtctcaaaaaaaaaaaaaaaaaagggggccttcaagcagcaagagatttgggtccagaaaaccatgactggcaaaagccaataattttgcccacagacttaatagttgcattatcatgtagtatacattgttatgttagtatgttatatgacattatattattttataaaattatgggcttttttttgttgtttggttttttttgagacggagtcttgctgtgtcacccaggctggagtgcagtggggtgatctcagctcactgcaacctctgcctcccaggttcaagcgattctcctgcctcagcctcccaagtagctgggactataggcgcatgccaccacgcttggctaatttttgtatttttagtagagacagagtttcaccatattggccaagctggtctcaaactcctgacctcgtgatctgcccgcctcggtctcccaaagtgctgggattacaggcgtgagccaccgcgcccggccaaaattatgttttataattttcttttttattttatttatgttatctactgcacaagaattaaagctctctgtgtatggccaggcctggtggctcacacctgtaatcccagcattttgggaggctgaggcaggtggatcacttcagatcaggagttcaagaccagcctggttaacatggtgaaaccctgtctctactaaaactacaaaaattagctgggcgtggtagtgcgtgcctgtaatcccagctacttcagaggccgaggcaggagaatcactttaatccgggaggcggaggttgcagtgagccaagatcccaccactgcactccagcctgggctacagagtgactccgtctcaaaaaaaaaaaaacacctccttgtgtagaagtttggtattgttcacttctgcatcctcagtgtctataagagtgaacaagctgggtgtggtggcatgcacctgtagtcccaacgacttggaaggattgcttgaacccaggagtttgaggctgcagtgagctataatcacgccaccgcactccagcctggatgacacagggagacccagtctcaaaaaaaaaaaaaaaaaaaaaaaaaaaaaaagcaggtgcggtggctcacgtctgtaatcccagcactttgggaggccaagacggttgggtcacatgaggtcaggagtttgagaccagcttggccaacatggcaaaacccagtatctactaaaaatacaaaaactagccaggcatagtggcacgcgcctgcagtcccagctactcgggaggctgaggcaggagaatcgcttgaacccaggaggcagaggtttaggtgagccaagatagcgccactgtactccagcctgggtgacagagcaagattccatctcaaaaaaaagaaagacaatcacaagttttttgttgttgttgtttttgagatggagtctcgctctgtcgtccaggctggagtgcagtggcacgatcttggctcactgcaagctctgcctcttgggttcacgccattctcctgcctcagcctcccaagtagctgggattacaggcgcccaccaccatgcccagctaatttttttgtatttttagtagagatgggttttcactgtgttagccatgatggtcttgatctcctgacctcgtgatccaccctcctcggcctcccaaagtactggaattccaggagtgagccaccgcgcccggcttgttttttttttttttttttgaaatttttgtgtttttagtagagacagggttttaccatgttggccaggctggtcttgaatgcctgacctcagctgatctgcctgcctcagcctcccaaagtgctgggattacaggtgtgagccactgtgccctgaccccatcttgtttttttttgttttttttttttttgagagggagtctcactctgccacccaggctggagtgcagtggcgcaatctctgctcactgcaccctctgcctcccgggttcaggcaattctcctgcctcagccttctgagtaactgggattacaggtgtgcaccaccacatccggctaatttttgtatttttagtagacatgaggtttcaccatgttggtcaggctggtatcaaactcctgaccttgtgatccacctgcctcggcctcccaaagtgctgggattacaggtgtgagccacacgcctggcccccatcttgtttttaaactccaaactgcccttggtcactcttgagtgtggagtgagctaacattgggagaaatttagttcatagtttaaaggataatggctcttccctaaactaagctgctttataaaactaataaaaggccacaagtttaagattataagaggggtctgaattctgctaaaatgtaggcatagttaaataattaccagccattgttctggaagtcacaacttccccagttagtcctgtaaataacatcactattataaaacttaagattggggccaggcacggtggctcataccagtactcccagcactttgtgtgccaaggcagaattgcttgagtccaggagttcaagacagcctgggcaacatagggagaccccgtttctacagaaaacaaaacaaaacaaaaatagcagtcatggtggtgcatgcctgtggtcccagctacctgggaggctgaggcaggaggactgcttgtgcctgggtggtagaggctgcagtgagccatgatcaaccactgcactccagcctgggtgacagagtgagaccctgtctcaaaacaaacaaacaaacaaacaaaaaacaaaaccaaagaaaccaaaaaaacaaacaaaaaaaaccaaaaacctaagattggccttccaagatatcttttcagatttttgcatttctgactactaggtaactccacttggatcagcaactcctctgtggcccttacccagaagcagactcagtgcacaaggactgttttccacagccctgtgattgcatccccaaccagtcggcagcacccattccctagcctcctgcctcctatccttgaataaccctagccttcaaatttcgggggtggttgatttgagtaataataaaactccagtctcttgcttagccaactctaggcatattaagctctttctctattgcaattctcctgttttaataaattggctctatctgggcagtggggaaggagaacccactgggcagttatgtacctatgtaaatgcatactaagaattttggaggctgggcacagtggttcacacctgtaatcccagtgctttgggaggcccaggcagaaggatggcttgagcccatgagttcaacaccagcctgggcaacatagtgagatctcatctctccaaaaaaatttttttttaaattacctgggtgtagtgacaagcacctgtagccccagctacttgggagactgaggtgggaggatcgctaaaacctgggacgtggaggttgcagtgagcagagatcacatcactgctctccagcctgggtgaccgagcaagatcctgtctcggaaaaaaaaaatttttttttggaagaatctacctaaaacctatgacagtggttacttcaggggaagggcctgagattgggaactgtagttgaaggctacttcagatttacctggaatgattctcagccaggggtgattctgccctttttttttttttcttccttctgctttttgcagagcagggctaccccacaggcaatgcgcccgaagtagttgattctgctctctagggatattgggcaatgtctggagatattttgggttatcacaaatggttgagatgggggagggtgctactagcatccagtgggtcaaggccggggatactgcaaaatagtccacaatgcttagcacagcccccgcaacaaagaattatccagcctaaaatggcaatggtgctgaaattgagaaccctgatctggatcattttaacttttataaggagataggattcaagtattatttgcataatttaaaaagggctgaaaaaacaatgatgtggcggggaggagtctctctgaaactattttggtctgggaggctgcctgattaaaaaaaaaaaaagacagggatgctgtgatccaccgtccaccttcccttccctctgcaggacacagcaggtattcccctagctgccaggagtgttagctgctactccctcacattctgatgagtccctcttcagaaattgccctgagctgaaggaagctgccttgttcaacagcctttctccttgagaagcctctgcactgttgacatcatgctttgtagcaggggttgggggaagtgtcctgtgccctgtaggacacgtggcagcattcctggcctctatccactagatgctagcagccccctctttttttttttttttttttgagagagtcttgctctgtgccccaggccggagggcagtggcatgatctcggctcactgcaacctctgcctccagagttcaagcaattcaattctcctgccacagcctccgaagtagctgggattacaggcgcgcaccaccatgcccagctaatttttgtatttttagtagaggtgggtttcaccatgttggccaggctggaccccttctcctattaaaataaccaaaaatatctctgaacatcaccaaatatcctctgggaggcaaaattctccccctccctgcattaagaaccactgatgtacccagtgcctggttaatacagcagcacaaaggcccagccccctgacctcagtttggagtatctctgagggccatctcaggctttgttgagattgcatcataaattcctctctttacccaatcctccttccctctccccatcataggtgttgttttccagagcattctccaataaatattctggtgcaaatctccctcccagagactgttccttggggccactgacccaagaccaagacgaaggcttaggggggttaagtggcttttcaaaggtcccacagcaggctggatgtggagctaagactgtgacctttctcctcactccacaattggtgctcacaagcattgcgcttcaaggccttattcttgggctctgctgaccacagctatctttttctttttttttgagacagagtctcgctctgttacccaggctggagtgcagtggcatgatctcggctcactgcaatctctgcctcctgtgttcaagtgattctcctgactcaacctcctgagtagctgggactacaggtgcccgccaccatttcctactaatttttgtatttttaatagagatgttgcccgccttggcctcccaaagtgctggcattgcaggaggagccactgcacccggtgcgcaactatccttgatctctagaggacttttcaacccccttgcctaccccatgtgtatttctataatagaagaaacagaagaaaaattcatagaatgtgcaacccagtggcatgaacttcagccctcttcctttgttgttcttaagcaatatatcttgtagttgtgcttgtctgcaccctctcaactggttgacagccagcaagttcaaacacatagacttttcaactacaagtatctaatatgattgcataaagtcctttgtgctcaaaaaacttaaaaaattttttttgttttttatagagacaaggtcttgctatgttgtccaggctggtctcaaactcttgggctcaagcgaacctcccatcttggtctcccaaaatgccggaattacaggtgtgaaccactgtgcctggccagaaaacttttttgtgtatttgttttttgtagagatggcagtctcactatagcccaggctagtctggaactcctgggctcaagaaatcctcccacctctgcattttttgtttttgttttttgataaaagtatggatgtgagataatgggcccatacaagtatgtggctgggacaaggtcatttctcggtatgatggtccatttctaacatcatgggacagttatggaggttagaatgctgtggtctggtgtgagaactcttgctatgccaataataataataaacattaggctgggtgaggtggctcacgcctgtaatcccaggactttagaaggccgagaccagaggattgcttgagcccaggagttcaagaccatcccgggcaacatagcgagacgctgtcctgttaataaataaaaataaaggctgggcgcggtggctcacgcctgtaatcccagcactttgggaggccaaggtgagcaaatcacgaggtcaagagatcgagaccattctggccaacatggtgaaaccctgtctctactaaaaatacaaaaattagccgggcgtgatggcaggtgcctgtagtcccagctgctcaggaggctgaggcaggagaatcgcttgaacccgggaggcggaggttgcagtgagctgagatcgcgccactgcactccagcttggcgacagagcgagagtccgtctcaaaaaaaaaaatcaataaaaatataaaagaataataaacattaatcgagctattgctatataccaaacactacatacttatatatatatttatgtattattaaatatatactatattaatatataatacatataatgtattttataattaatagttaatagtaacataatattaatattatattactgtatgtatatatactgtataggtgtatgtatactgcattgtactttactatatttactgttatatatatacatacatatttataacatataaaataacattatatatcaagttatcaataggcagatattgttatttcacccacttactggtgagaaatctgagtcacagagaagctaagtaacttactcaaagtcacacagctagtaaatggcagagccactccagcctgcatgaccgctcttcattttcagaaggtgcggctctaactcagagcacatttattcaactgaatgcatttatgaggaagatcttgaaagcctgtctccctctctccctcccaacacatcaaaaaataatggaatgtaaaacaattggctggtcttcatcttaaactggtcggcttaagctggtcagtgtcaaccaggttcaagttatggaactgtgtgtaaatgttgaaaatgtatcattgtatcttttttttttttttttaagagacagggtctccatatgctactatgactagcagcatagtcatagctcactgtaaccttgaactcctgggctcaggtgatactcctttcacctcagcctgctgagtaactgggactatagacaggcaccaccacgcttggctaattttttaattttttgtacatattggagtctcactatgttgcccaggctggtttctttcttttttttttttttctcctgagatggagtcttgctctgtcacccaggctggagtgcagtggcgctatctcagctcattgcaagctccacctcctgggttcacaccattctcctgcctcagcctcccaagtagctgggactacaggcacctgccaccacgcctggctaattttttgtttatttttagtagagacggagtttcaccgtgttagctaggctggtctcaatctcctgacctcgtgatccacctgccttggcctcccaaagtgctgggattccaggcatgagccatggtgcccagcttgcccaggctggtttcaaactcctgccctcaggtgatcctcccacttcagcctcccaaagcattgagattagaggggtgagccaccatacctagccctgtgtattgtatcttaaaaggaaaatgtaattatggatttatggtatattttcttttttttttgagacggagtctcactctgtcacccaggctggagtgcagtggcgcaatcttggctcactgcaagctccgcctcctgggttcacaccattctcctgcctcagccgcctgagcagctgggactacaggtgcccaccaccacgcccagctaagttttctgtatttttagtagagatggggtttcaccatgttagacaggatggtctcgatctcctgacctcgtgatctgcccgcctcagcctcctaaagtgctgggattacaggcgtgagccaccgcgtccggccaatttatggtatattttcttgcattgaaactggaaactcttgcaacacataagtacattattcaacttccagttattcaagaaacactctaatttttttagccatcatgtattgcataaaaacagtgggagagttgatcaattactcactgtttatttaaagctgtggtttaaacactttctgtatagtatctctttattgaaggattgttgagagagctggaattacctctgtcactcatctttgtgctaagaaaccctgatgtgtgttttgtattggttagtttttgcttctctactgatgaacaggatctgatcaagttgagcttgcagtagaataattcacagaaaagtgcagggtgcggtgagtcacgcctgtaattccagcactttgggaagccaaggtgggtggatcacgtgaggtcaggagctcaagaccagcctggccaatgtggcgaaaccccgtctctactaatagtacaaaagttagccgggcatggtgacgcgtgcctgttgttccagctactcaggagattgagtcaggagaattgttggaacctagagacggaggccgcagtgagccgaaatcgctccactgcactccagcctgcgcgacagagcaagactctgtctcaaaaaagaaaaaagaaaaaacaaaaaagaataattcacagaaaagttaagaaaggttatctatggcctcttaatcttcctgatctgaaacggcaacttggggtaagggaagaatgttgaggaagtggagcataaaaaaaaaaaaaaaagaggaagaagagaaagagaagagggagtgagggggagagagagtgaggaaggaagggaagaagggagggagggaggaaagagaaaaggaaagaaagaaggaagaaaaaaggaaggaagagagaaaaagagaaaaggttggtgtcataaatagtgtaaatatacttaataagcaagtgaaatcaaaggctgagtagtacgtcatactgatgtctagtattttaaaatttaggctgggcacggtggctcacacctgtaatcccagcacttcaggaggcagcggcggatggatcacctgaggtcaggagttcgaaaccagcctggccaacacggtgaaaccctgtctctgctaaaaatacaaaaattagccaggtgtggtggcgtgcacctgtaatcccagctactccggaggttgaggtaggagaatcgcttgaacccgggaggcggaggttgcagtgagccaacattgtgccattgcactccagcctgggagacaagagtgagactcagtctcaaaacagaaaaaaaataaaaaacatttttaaaaaaaaggaaaaaggagaaaaatttggacacagagacatggacatacaaggggagaaggcaggtgaagatgtaggcagagcatggagtaatgcatctacaagccagggaaaaacaaaaattgctggcaacctctagaaggtacaggtggcaaggaaggaatcttccctagaggtttagaagggagtccagccccgctgacaccttgattttgagcttctagtctctggaactgtgaaagaacatgttttggttgtttaaagctactaagtttttggtaatttgtcattgcagccctacgatacaaatatattcacaataaaataaatgaaaattaaaattatactgacatgccatttttaacccgccacttagacaaagatcaaaaagcctgataacagactaagttagaaaatgtgttgggaaattgattgcttttatttgctgctggtgggagtgaatgtaaactgatataatctctagaaattacttgacaatttctatcaaaattacaaatgcacatatcttttgacccagcaattctgcttctaggattttctgacattggagaaagttgcatacgtggacaattgcacatggacacgttatgtatcacagcactctctgtaaccacagacatttggaatgaacactaactgttcattgtcaagcgatgtttgagtacactgaagaacatctatacttggagtcagcaaactttttacataatgggccagagagtaagtactctaggtttgcagacccagagggctctggtgcaatgactcaactctgcagttgtagctcaaaagtagtcatacaggctgggcactgtggatcacgtctgtaatctcagcactttgggaggctgaggcgggtgaatcacctgaggtcaggagtccgagaccagcctggccaacatagtgaaacctcgtctctaccaaaaatacaaaaattagccggtgtggtactggacacctgtaatcccagctactcggaaggctgaggcagaagagttgcttcaacctgggaggcagaggttgcagtgagctgagatcgcaccattgcactctagcctgggcgacagagcgagactccgtcttaaaaaaaaaatgtagtcatatatcatacatcatatataagtgaatgggcatggttgtgttccaataaaactttatttacaaaaaacaggcaatggccagatttggcccatgagcctgtttgctgatccctgatctattcaatggaatattatgagctgaaaaattagtgaggtggctatgttctgctccacagtgacttccaagattaagtgaagaaagcaagattcagaacagtatggatttgtcagaaaaaaatatataaatttatataaagaattatttgtatattcacaggcaatgtctggaagtatccataagaaagtggacccattacttatttctgggataggaaactgggtggctcagtgtctcagtggggaagatattttcctttgtgctttttgaattctgaaccaagctgaaattattacccattcagaaaacaaaataaaaatgtgaaaaggtaagcaaatttatttccctaccacatactttttctttgcagggccagtgagcacaaatggtttttagttccgtttttgtttgtttgtttgcttttaatagagatgacatctcactttgttgcttgggttggtttcaaaaaggcaaatttttcttctttcttttcttttttttgggatggagtctcgatctgttacccaggctggagtgcagtggcaccatcttggcttactgcaacctctgcctcccaggttcaagcaattctcctgcctcagcctcccgagtagctgggactacaggcatgcaccaccaagcccagctaatttttgtatttttaatagagacggggtttcaccatgttggccaggctggtctcgaactcatggccccaggtgatccttcggcctcagcctccccaaatcctgggattataggcatcagctatcacacctggccgggttttcacatttttggatggttgaaaacaaccccaaaaagaataatattttgagaagggggtgggggaaaaaagaatattttgtgacaaaagaaaattatgtgaaattcaaatttcagtgtccacaaataaagtgtaatggaacacagccctgcctattcatttgcattctgtctatgattgctttgccttacactggcagacttgagtcattgtgacggagagcccataaagcctaaaatatttatctggtcctttacataaacagtttacagattgttgttctagattaaagaacaaaacaatctttcacatgcttctacaaatagaaagttcatatttaatattgaatgaccattccatgaggactttaaaaaatgaaatggcttatgaagaactcaaaattaaattgtgaattttcttgcttcttcttagagaatattttaaaaagctgtggcctctaaacaaaaataaagcacttatcccatctgtctgggtctcactgtgcaccgtgttggtgaggccatcagaatgaaaatgtatcacaacccaccttcccctttatttttatttcttattttattttatttatttatttttttgagacggagtcttgctctgccacccaggggcgcgatctcggctcactgcaagctaggcctcctgggttcacgccattctcctgcctcagcctcctgagtagctgggactacaggtgcccgccaccacgcctggctaatttttttgtatttttagtaaagacggggtttcaccgtgttagccaggatggtctcgatctcctgaccttgtgatccacctgccttggcctcccaaagtgctgggattacaggcgtgagccactacgcctggccttatttttatttttaatttatatatatatatatatttttgggggggggggcagggacagggtctcactctgttgcccacactggagtgcagtggcgtgacctgggctcaccacaacctccgcctcccgggttcaaacgattctcctgcctcagcctcccgaatagctgggattacaggtgcgtgccactgctgccggctaatttttgtatttttagtagagacagggtttcaccatgttggccaggctggtcttgaactcctgggctcaagtgatcctcctgcctcagcctcccaaagtgctgggattacaggtgtgagtcactgcatccgcccctccctgtcccttatttgacagaaaattcaaagtacttgatgttaacaaaaagctgagatgacctggaattgcttttaatttttactaagaatgaatcaaagctttctgttgttgttttgatggtgggaagaacacacttgtgcctttttttttttaaatcaccgataaaacaaggatacaaggaaactctgccttctgaaagttttgttcttggtttataagagacaataaacccacataaaaagttatgtaataagaggacagtcaataactatgttttcaaccttttcggcaatgatccacagtaaaatatatgttttatactatgactcagtagatacatatatacacacacaaaaaaataaaaatatggggctgggtaaggtggctcacacctgtaatcccagcacttagggagatcaaggtgggtggattgctcgagcccaagagtttgtgaccagtctggacaacatagcaagaccccgtctttacaaaaaaataaaaaaaactagccaggtgcagtagcatgccagtggttccaacagctggggagactgaggagggaggatcacctgagctcaggaaatcgaggctgcaatgagccatgatcatgtcattgcattccagcctgggcaacagcaagaacctgtttcaaaaaaagagaaaaggcaaaaatttttttttcttgagacagagtctcactctgttgctcagggtggagtacagtggtgcgatcttggctcactgtaacctccaccttccaggtttgagtgattctcctgcctcagcctcccaagtagctgagaatacaggtgtgtgccaccaggcttggctaatatttgtatttttagtagagatggagtttcaccatgttgaccaggctggtcttgaactcctgacttcaggtgatctgcccacctcggcctcccatagtgttggggttacaggcatgagccactgtgcccagccagaaaagacaaatctatttttttgtttgtttgttctttttttgagttggagtcttgctctgtcgcccaggccggagtgccgtggcgccatctcggctcactgcaacctccacctctcgggttcatgccattctcctgcctcagcctcccgagtagctgggattacaggcacgtgccaccacacccggctaatttttgtatttttagtagagaaggggtttcgccttattggccaggctggtctcgaactcctgacttcgtgatccacccgcctcagcctcccaaagtgctgggattacaggcatgagccatcgcgcccagccagaagagacaaatctattaaggcaaaaagtacattagtggttgcctggagctgggagtgggatcagagattaaggataagcaggcctgagagttcctgctggggtgatgaaaaagctgcattatattaaaaatttactaaaaataatcgaattacacaaacaaaagcagtagatttcatggcatgtaaattacatagcaataaaactgtcttttaaaaaagagaggaagaaaagaagaagcaaaagaaaagaggccgggcacagtggctcatgcctgtgatcccaacactttgggaggccaaggcgggtggatcacctgaggtcaggagttcgagaccagcctggctaacacggcaaaaccttgtctctactaaaaatacgaaagttagctgggtgctgtggcgtgcgagtgtagtcccagctacttgggaggttgaggcaggagaaccgtttgaacccaggaggcagaggttgcagtgagccgagatcacaccactgcactccagcctgggcaacagagcaagactccgtctcaaaaaaaaaagagagagagagaaaaaaaaaaaaaaaagaggaagaggaagcggaagaataaccacccaaaccaatcggtctgcagggcttgggattcagcttttaaaaattacatacatttgcccaactccaatcttccagttgttcccactctccacaatttcttgaagattactgcctgcatttcctcggtcacatgtgccaattatttcagtcctctggaatgtcattcatcaggtttagaaacttttcgacaaggtgaatatggtaacgaagtccaagagttggatgttttcccgcccttctgaacctcttcccttcgcatactcttctcctctgatgacttctcctttagtccgtgtttacattttgtgatttcttagacgtgagctcctaggcaacagaaagagctggggtagttgcgtgcacagtgagatgcaccttaggaaactgtgggcttctggggtggccttcccctaagttccctgtgtgactgttgtagatgtttgtagctcagtctacctagcaacccctcctccttctggaaacagctctaggtttcctgggtggggtttccttctcccccttggtgtctgtggtcctggtgaggcagaccgccacccatgggctccaggaataagcaggcgactcaggtcaatccggacaccaacatagctcagctctggctgtggtgattggctgaaagatggacatgtgacctaagagagtccagtgaaagtcagttctgagatgttttctagaaatactggaaaagagatgttctttttctaccatgattgctttgtggtgggatgtaaggttgactgctgtgagcctcgctgggccaccatatgggaaattaccaagaatgaagcatttacctttcctatagtccctgaaaaaaaaaaataaaaataaaaatgaaaataaaaataaaaatgaagctaacacaggccgggcactgtggctcatgcctgtaatcccagcactttgggaggccgaggtgggcacatcacccgaggtcaggagttcgagaccagcctggccaacatggtgaaaccccgtctctactaaaaaaattacaaaaattagccaggcgtgctggcatgtgcctgtaatcccagctactcaggaagctgaggtaggagaattgcttgaaccctggaggtggaggttgcagtgagctgagatggtgccactgccctccagcctgggcgacagagtgagatccgtctcaaaaaaaaaaaaaaaaaagttaaataaaggaaatggatcaggaaatagagacagccagacgcagtggctcacgcctgtaatctcagcactttgggaggccgaggcgggtggattgattgagaccaggagtttgagaccagcctggccaacatggtgaaaccatacaaaattaactgggcgtggtggtgcatgcctttaatcccagctactaaagaggctgaagcagaagaattgcttgaacccgagagatggaggttgcagtgagctgagatcgcatcactgcactccagcctgggctacagagcgagactctgtctcaaaaaaaaaaaaaaaaaaaaagaagctaacacaaaggaaatgaatcaagaaatagggaaacagtactgatctcactgtgtgagcctctgggtccatccatacctaaagctggtacaagctgtacccttgctatcaggtgagcctgtgaattctcttttcataaccaatttgatcgtgatttttgtcacttgttggcaagaataacacagtgtctggccaggtgcgatggctcacatctgtaattctagcactttgggaggccaagggcgagggatcactggaggtcaggagtttgagaccagcctggccaacatggtgaaaccccattgctacaaaaataccaaaattagctgggtgtggtggcaggcacctgtagttccagctactcgggaggctgaggcaggagaatcgcttgaacccgggaagtggaggttgcagtgagccgagatcatgccactgtgctctagcctggatgacagagtgagactctgtctcaaaaataaataaataaatacataaataaaataaaataaaaataaaataatgaataaaatttttaaaaatgtaaaaaaacccatccaggaatggccagttatttcccaacatccattttttgcccttcttcacattaagagagtccaattttttctctttttttttgtgaggggacagggtctcagtgtgttaccgaggctggagtgcagtggaacaatcacagttcactgcagtctcgacctcctggactcaagccatcctcccacctcagcctctcaagtagctgggaccagagacacgtgccaccacacctggctaaattttttttcttttcttttttttttttgtagaaacggtctcactatgctgcccaggctgttcttgaactcctggactcaagtggtcctcttgtctcagcctcccaaagggctggaatgataggcatgagccactgtgcttggccagattccaatttttattctagcacgttgccacctagaacttagaataaaggttaaatttcccggtttcctttgcagttaggtatagatgaaaaagtagtgtcactttatagcttagtcatatgtctaagttctggccaatgagatgtaagttgacatgagtggaggctcccagaaaggaaagggtgcacccttttctcccttcccgcttcctgctgccaggaatgcagatttgatggatggcattccagccactatcttgagtcatgtggatttaagaatggaagcagacagacagaaacaaggtttctggggaaagaggacccaccatgccagccttggagaactaatctatagacttcttttacatgagaagagaaataaacttttatctcattgaagccaccaatctgtcctgtctctgttactatatccaaagttgagtctgattgacagtgccatgttcctcacaccctggccacatgttgtattatcagttattttttcatttagcctatctgacaggtgaaaaagtagtgtcacttcatagttgtaaattcatttctgataagagctgatcttatttttgtagattttgagccatttgtgggattttgggtctgtgaaccatcttccctcccttcccctcctcttctctcccctcccctctcctctcgtctttcttttctctccctgtctctctctctccctttctttcttccttttttttttttttttccagacagggtctggctctttcacccaggctgcagtgcagtgctgcaattatgaatcactgcagcctccacctctctaggcttaagcaatcctcccatttcagcctcccaagtagctgagactataggtgtgcgccaccatgcccagctaacttttttagggatggtgtcttgccgtgttgcccaggctggtctcaaacggctgggcttaagcaagcctccagccatggcctccccaagtgctgggattacaggccccatttctttctttctctcttttttttttttttttttttttttgagatggagtcttgctctgtcgcccaggctggagtgcagtggtgcgatctcggctcactgcaagctccgcctctggggttcacgccattctcctgcctcagccttccaagtagctgggactacaggcgcccaccacctcgcccggctaattttttgtatttttagtagagacggggtttcaccgtgttagccaggttggtctcctgacgttgtgatccacctgcctcggcctcccaaagtgctgggattacaggccccatttctttcttgactccattctcagtcagccccattcctgtgattccaagatggctgccagcagctctggactttcatcccacctctcagcaccctcagcagggagaatgccgctttcctggatggtgcaacaaaagtttagggattgtcacgagaaagagaggacaagccacagactgagagaaacatctgcaaaaacatatcttgataaaggtcttttatccaaataacacaacaatccggctgggcacagtggctcttgcctgtaattccagcactttggaggctgaggcaggtggatcgcctgaggtcaggagttcgagaccagcctggccaatacggcgaaacccagtctctaccaacaatataaaaattagccaggcgtggtggtgcatgccataattccagctactcaggaggctgaggtaggagaacggtttgaacccaggaggcagaggttgcagtgagccgagatggcgccattgcactccaacctgggcaacagagcgagactccgtctcaaaaaaaaaaaaaattaattaattaaataaaaataaaaataaaaaaacacgtaactcaacaatctgaaaatagagctgggcatggtggcatatgcctgtagtctattcaggaggctaagctaaaagaatcacttgagcccaggagttcaagattgtaatgtgctatgatcctgactgtgaatagccactgcactccagtttgggcaatatagcacgatgctgactcgtttaaaaaaacacgaacgtgaacgacctgattaaaaaatgagcaaggccaggcgtggtggctcatgcctataatcccagcactttgggaggctgaggcaggtggatcatgaggtcaggagttcaagaccagcctggccaagatggtgaagccccatctctactaaaactacaataattaggcgggcatggtggcaggtgcctgtaatcccagctactcaggaggctaaggccggagaatcgcttgaacctgggcagcagaggttgcagtgagccaagaacacaccactgcactccagcctgggcaacagagtgagacctcgcctcaaaaaaaaaaagccagaggtggtgactcatgcctgtaaatccagcactttgggaggctgagatgggtggattgcttgagcccaggagttcgagaccagcctaggcaacatggcaaaaccctatttctacaaaaaatacaaaaaattagctgagtgtgaaggcacggccctgtagtcccagctacttggcggggctaaggtaggaggattgcttgagccaggaaggtagaggttgtagtgtaccgaaatcacactacactccaccctgggtgatagagtgagaccctgtctcaaaaataaattaaaaaaaaattaaaggcctggcacagtggctcacgcctgtaatcccagaactttgggaggccgaggcaggtggatcacctgaggtagggagttcgagaccagcctgaccaacatggacaaacgctgtctctactaaaaatacaaaattagctgggcatgatggcacacatttgtaatcccggctactcgggaggctgaggcaggagaaccgcttgaacccgagaggcagaggttgcagtgagccgcgatcctgctattgtactccagcctgggcaacaagagtgaaactacgtctcaaataaaaaaaaaaaaaaaaagaaaaagaaaattaaaattaaaaaataaatgggcaaaaaactctgaacagataccttaccaaagaagatatacacggccgggcatggtggctcatgcctgtaatcctagcactttgggaggccgaggtgggtggatcatgaggtcaggagttcaagaccagcctggccaagatggtgaaaccccgtctctactaaaactacaaaaattagctgggtgcggtggcaggtgcctgtaatcccagctactcgggaggctgagggaggagaatcacttgaacccgggaggcagaggttgcagtgagccaagattgtgccactgtactccagcctggacgacagagcaagactctgtctcaaaaaaaaaaaaaaaaatatatatatatatatatatatacacacacatagcaagactctctcaaaaaatatatgtatatacagatggcaaataagcacataaaaaagtgcttaatgtcatatgtcattagggaattgcaaattaaaaaaatgaggtaccactactcacctattagataacagctaaatttttttttctttgttttgagacaaggtctcattctgccacccgggctggaggacagtgacgtgatcactgatcactgcagccttgacttgctgggttcaagggatcttcccacctcagccttctgaatagctgggactacaggtgcacgccaccctgcctggctaatttttaaattttttgtagagatgggagtctccctatgttgcccaggctggtctcaaactcctgggctcaagtaatccgctggcctcagcctcccaaagtgctgagattacaggcatgagccactgtgcctggcctaggatggctaaaattttttcttttcttttcttttctttcttttttttttttttttgaggcggagtctcgctctgtcgctctgtcgcccaggctggagtgcaatggtgatatctcggctcactgccacctctgtctcgcgggttcaaacgattctcctgcctcagcctcccaagtagctgggattacaggcaagtgccaccatgcctggctaatttttgtatttttagtagaaacgggttttcaccatgttggccaggatagtctcgatctcctgaactcatgatcctcccacctcagcctcccaaagtgctgaggttacaggtgtgagccaccatgcctggccgaatggctaatgactaaaatttttaaaaatgacaacaccaaatgctggtcaagatgttgagcaacaggagctctcattcattgctgtggaaatgcaaaatggcacagctacctcggaagacagtctgatagtttcttctaaaactgaaatgctcttcctacatgatccagcaattgcactccttggcatttaacccaagtgaatcggaaacttacatccacacaaacactcgcacacaaatgtttataacagatgtattcgtaattgccaaacttggaagcaaccaagctgtccttcagtaagtgaatggataaactgtggtacgtccagacagtagaatattattcagtgctggccgggcgcagtggctcatgcctataatcccagcactttgggaggccgaggctggcggatcacttgaagccagtagttcatgaccagcctggccaacatggcgaaaacccatctctattagaaaaaaaaaaaaaaaaaaatagccgggcatggtagcacacacccgtaatcccagctactcaggaggctgaggtgggagaattgcttgaacccaggaggcagaggttgccgtgaaccaagattgcaccactaaactccagcctggatgacagagcaagactctgtctcaaaaaaaaaaaaaagaatattatttagtgctaaaatgaaataagtcgccaaaacataaagaggtgtggagaaaccttgccttagtctgttttctgttactataacagaatactagagactaggtaatttataaaggagagaggtttatttagctcaagattctggaggtggggttgtctaagatctgcaggatatgggattcagcttttaaaaactgagcttctggtcgggcttgtagcttacacctataatcccactacttcaggaggctgagacaggaggatcactgaaggccaggaatttgagaccagcctggacaagatagggagacctcttctctacaaaaataaaaataaaatgggccaggtgcagtggctcacacctgtaatcccagcactttgggaggctgaggtgagcggatcacaaggtcaggagatggagaacatcttggccaatatggtgaaaccccgtctccactaaaaatacaaaaattaggccgggcatggtggctcatgcctataattccagcactttgggagcactttgggaggctcgttcaattcgagcacttgaacgcctgagatcaggagttcaagaccaacacggtaaaaccctgtctctactaaaaatacaaaaattagctggatgtggtggcacgcacctgtaatcccagctactagggaggctgaagcaggagaatcgcttgaacccgggaggcggaggttgcagtgagctccaatcatgccattgcactccatccagcctgggcaacagagtgaaactgggtctgaaaaaaaaaaaaagaattagccaggcatggtggtacgcacctatagtcccagctactctggaggctgaggcaggagaattgcttgtaactgggaggcagaggttgcagtgagctgagatttcaccactgcactccagcctgggtgacaagagtgaaactccatctcaaaataaataaaatggctgagcatggtggctcatgcctgtaatcccagcaatttgggaggccgaggcaggtggatcatttgaggtcaggagtttgagaccagcctggctaacatggtgaaaccccacctctactaaaaatacaaataaattagctgggtgttgtggcacacgcctgtaatcccagctactggggaggctgaggcaggagaatcgcttgaacctgggagacacaggttgcagtgagctgagatcacaccactgtactccagcctgggcaacagagtgagactccatctcaaaaataaataaataaataaataaaataaatacaaataaaaataaaaattaggtggacatggtggcctgcagtctcagctactggggaggctgaggagggaggatggcttgagcccaggagtttgaggctgcagtgagctgtgacagtgccactgcattccagcctgggtaacagaggaagatcctgtctgtaaaaaacaagcaggctgaccatggtggctcatgcctttaattctaacactttgggaggccaaggtgggaggattgcttgagcccacgagttcaagaccagcctgggcaacatagtgagaccccatctctaccaaaaaatttaaaaattagctggacattgtagtgcatgcctgtagtcccagctactcaggaagctgaggtgggaggattgcttgagcccaggaggtcaaggctacagtgagctgtgatcatggcactgcattccagcccaggtgaaagagtgagaccctgtctcaaaaacgaatgaatgggctgggcgcggtggctcatgcctgtaatcccaggactttggaaggccaaggcgggcagatcacgtgaggtcaggagttcaagaccatcctggccaacatggcaaaacaccatctctactaaaaatacaaaaagtagccaggtgtggtggtgcgtgcctgtaatccaagctacttgggaggctgaggcaggagaattgcttgaacctgggaggcagaggttgcagtgagccgagatcatgccactgcactccagcctgtgcaacagagcgagactccgactcaaaaaaacaaaaccaaacaaaaaaaaagaatgaacaaagaaaaattgagcttctagtgagggtcttgtgctatgtcataacatgatacagaagaggaagcagacatgtgcaaagtgaccaacacaagaagcagtctcgcttttttttttttgagatggagtttcactcttgttgcccagggtagagtgcaatggcacaacctcggctcactacaacctctacctcccaggttcaagcaattctcctgcttcctgagtagctgggattacaggcgtgcgccaccacacccggctaattttgtatttttagtagagacggggtttcaccatgttggtcaggctggtctcgaactctcaacctcaggtgatccacccgcctcggtctcccaaagttctgggattacaggcgtgagccaccatgcccagcctgcagtcttgctttataacaacctgctttggagctgatgaatccaatcccatgggatcgagaactcaagggaatgagaaagaccttaatacatcttaatgacctaatcaccccttaaaggcaccacctaccaacactacctcattgggacaaagtcacgacataaatttgagtggggacaaactgtatttaagccatagcaaacctaaaatacttattatcaaatgaaaataagccaatgtggaaagactacaaactgtatgattccaattatatgacattccggaaaaggcaaaactatggagacagtcaaaatatcagcagtttccaggggttaggaaggaggagatgtaggtggtacaccgaggatttttagggcaatgaaatcattctgtctgataccataatgtgcttacattttactatacattggtcaaaacccatagaactgcataataccaagagtgaaccctaatgtaaactatggacgttgattcataatgaggggtcatgagggttcatcaattttaacaaatataccactctggtgcaggatgttgataatcagggaggctgtgcatgtgaagagactgggtatatgggaactctccatattttttattttatttatttatttatttatttatttatttatttatttattttgtgatggagtctcactttgttgtccaggctcgagtgcagtggcatgatctctgctcactgtaacctctgcctcccaggttcaagcgattcttctgcctcagcctcccgagtggctgggattacaggtgcccaccaccatgcccagctaatttttgtatttttagtagagacggggtttcaccatgttggccaggctggtctcgaactcccaacctcaggtgatccacctgcttcaccctcccaagggctgggattacaggcgtgagccatggcacccagtctatttatttatttatttgagacaggatctcactctgtcacccagactggaggacaatggcacaatctctgttcactgcaacctccgcctcccaggctcaagcgattctcctgcctcagcctctccagtaactgggactataggcatgcatcaccacacctggctaatttttgtatttttagtaaagacggggtttcaccatgttggccaggctggtcttgaactcctgacctcaaatgatccacctgcctctgcctcccaaagtgctgagattacagatgtgagccatggcgcccagcccatattgttttttttagagacaggtcttgctctgtggcccaggctggaatacagtggtgtgatcatagcttgctgcagcctcaaactcccaagttcaagggattctcccacctcagtcacctcccaaatagctgggactgcagacatgagccaccacgctcatctaatttttctattttttagaggcagggcatccccatgttgcccaggctggtcttgaactcctggctcccaaagatccttttacctggtctccaaaagtgttgcaattataggcatgagccaccatgcacaaccagctctgtgttttgccttcaattttgctgtcactctaaaactgctgtatattatagtctatttttaaatttaattatttttatttttattttattttttttgagacggagtctcactctgttgcccaggctggagggcagtggtgcgatctcagctcactgcaagctccgcctcccgggttcacaccattctcctgcctcagcctcccgagtagccgggaccacaggtgccagccactatgcccggctaattttttgtatttttagtagagacggggtttcaccatgttagccaggatggtcttgatctcctgaccttgtgatctgcctgcctcggcctcccaaagcgctgggattacagacgtgagccaccgcgcccagcttaaattttaattttaattaattaatttattttttgagacagagttttgctcttgttgcccaggctggagtacagtggcacaagctcggctcattgcaacctctacctcctgggttcaagtgattctcctgcctcagcctcctgagtagctgggattacaggcacccacccccacgcccggctaatttatttgtacttttagtagagatggggttttgccacgttggccaggctggtctcgaactcctgacctcaggtgatccacccacctcagcctcccgaaatgctgggattataggcgtgagcccctgtgccttgcctatagtctactttttaaaaggagagggggattggccctgaatggatcaacttaggtcatatgactctctctgttctaatgaatgtggccagaggaattgagcacactggttagtcatgttcaggtgcatgctcatctctggagccaggagtggaatcagccctccaaaacacatggaggccaggtttggtggctcatgccggtaatctcaacactttgggaggctgagccaagcagactgtttgagcccaggagtttgagaccagcttgggcaacatagtaagaccctgtttctaaaaaagaaaaaataaaaataaattaattaaccaggtgtggtggcatgtgcctgtagtcccagctactcaggaagctgaggggggaggattgcttgaactgggtagttcaaggctgcagtgaactatgattgtgccactgcactcctgcctgggcggaagagctagaccctgtcttcaaaaccaaaccgaaacaaaaaaaacacacggattagggatgggagggatagaatcctagaaagaaattaaggacttgtttccagagaagaggggaacagatattcagaggttaaatcaatagatattgactctcctaggcaaagaggagaatgaaatccttgtgatcagacagcacagagtccagaggccttgttgataaaagagatggaatttgtggaaatactgagtgatccattctcatttagatgtccaattaactcccattcacgtcagctttattaatttattgaccacctaatatgtcccagactttgtgcttggagttgaagagacttttgtgaataacaactcagccaacaagtccatgaattttcaaaggctccatgtttattccgtgcacatttagaagaccttgcaaatttcaccactatgaaattaaatttcacatggcctaattagaatatccgcacccctaaattattgcaattgcagagaatcggagggttcaaaggaaagcagggcactcacgtaattcaccacaacccccaggctgctggaacacttggttaacttttgaccttggccaactccagtgaccacttgaagggaagaaagtgccatcccaggattgcccatgattactcttgggtggttagacccctaactgtgtgcgtcaatctggagatgttgttactgttcaaaagagggggacatgaaccacaaattaattggttttacataggcttttaaaaccaacaaaattaactttttaatattgttcatgaaacgaaatacaaaccctttattattttaaattttagtgtctggacacttttgaagtggttttgtccgttttttttcataaaatactgccactgctccattactgtttgtgaggaagaaagtataataacacattgttttctctgcccccgccaccaccccaccatggttcctgtttttatatatatatatgtatatatgtgtatatatatgtgtgtatattttttttttattatttttttttctgagacggagtcttgctttgtcacccaggctggagtgcagtggtgcgatcttggctcactgcaacctccacctcctgggttcaagcaattctcctgcctcagcctcccaagcagctgggactacagatgcgtgccattatgcttggctaattttttttatttttagtagagacagggttttgccatgttggccaggctggtctccaactcctggcctcaagtgatccgcccgccttggcctcccaaggtgctgggattacaggcttgagccaccatgcccggcctcttgtttctatattaaagagacatttacctaactagataaagacctgctatgccattaacttaacttttttttttttttttttttttagagacagggtctcactctgttactcaggctagaggtgagtggcacgatcacagctaacctcagccttgacctacctggcttaagtgatcctcccacctcagcctcccaagtagctgggaccataggtgcagcgtaagccaccacatcatttagcagaaacggggtcttagtatgttgcccaggctgttcttgaactcctaggctcaagccatccaaccacccaatctctcaaagtgctgggattacaggtgtgagccaccacacccatctcacaccattaactctttcagtcaatctgcattaagcatttagtatgtacttggtactatggaaagcatcaaagaaattgacactacaggttctaaaaactttccattgaggaattaagacttagtcggtctctagctgtgtgatcttaagctagttacttaatgtctctgagtttccatttcctgatctataaaataaggatgaaatattgctcttgcaaggctcttgtatatccatgtattcagcaaatatagcttgagttcctactcagtgttccacacacctttaggaagcagagattcagtagtgctgggcattggaaggagttttcagtggggatggaatccaggctgcaaagagaaagcatttgtatgtgaacgcttctggaaaattacttaaagctgggctcagtggcacacgcctgtagtcccagctgcccaggaaactggggtgggaggatctcctgagcccgggaggctcaggaggctgcagtgagccatgattgagtcactgcattccagcctgggagacagagcaagaccccgtctagaaaaataagtaagtaagtaaataaataatgacctaaaaccatcccagaagacaggaacatgagtctctgaaggcctctgtattagctatctattgctgtgtaacaaattgcttcaaaatttagcagcttaaaccaataaaacatttatctcacagtttctgtgggtcaggaatccaggagtggctttgctgggtggttctgcctcagggtatctgccctgtttacagtcatgctgttggctgggctgcagaggctggaagcctctttggggccagatgatttgtttctgagcttgttcatgtggttgtggtcagaaggtttcagtccctcatgacatggaagctggctccctcactaagtgagagagagagagaaaccaagagagaagttttaagaaagagagaggggctgggtgtggtggctcacaactgtaatcccagcactttgggaggctgaagcgagcagatcactggaggtcaagagtttgagaccaccctggccaacatggtgaaccccatctctactaaaaatacaaaaattagccaggtgtggtggtgcacgctgtaatcacagctacccaggaggctgaggcacgagaagcacttgaacctagaaggtagaggttgcagtgagccaagatggtgccactgcacttcagtctgggcaacagagtgagactccatctcaaaaaaaaaaaaaaaaaaaaagagagagagagagaaagaaccaagacagaagcagtattgtcatgatgcaccatcacttctgcctaattttacgggtcacacagaccaccctggtgcaatagaggagggcactgcacaaggtgggcacaccaggaggcaaaggatcattggatcactggagggcattttggagtctggctaacacagccccatgacttttttgtgatttctcattttattttatttatttttttgagacaggatctcactttgtcactcaggctggagtccagtagcatgatcttggctcactgcagcctcaacctaccgggctcaagtgatcctcccaccgcagccccccataagtagctgggactacaggtgcacaccgccacacttggctaaattttttgtgtgtgtatatttttagtagagacagggttttaccatgttggccaggctggtctcgaactcctgagctcaagctatctgcctgcttcggcctccccaagtgctgggatgacaggtgtgagccactgcatctggccctgttctcactttaaatattcacctttttccttctcctcctcctcttcctctcctcctcctccttcttcttccttcttcttcttctacttttctttcttcttcttcttttttatttatgtttttgaaacaggaaacagggactcgctctgtctcccaagctggaatgcagtggtgcaatcacggctccctgcagtgtcaaccttctgggctcaagcaatcctcctgcctcagctcccgagtagctaggactataggcacatgccaccacacctggctaattttaaaaaatcttttgtagagacagggtctcacatgttgcccaggctaatctcgaacccctggcctcaagcagtctttccacctcggcctcccaaagttctgggattataggcatgagccactacacctggcctaaacattcacttttatacctaattttgtacttaaattttgtatttgttttaaagaaggctcccccaaattgtctaagcttcaggtaccacaaaacctggatccatccctggtcctaagacaggtcttcagttttttgtgacagtgggtgttagagattttgtacaaaagttcagaagctggactcagcccagcgaaaaggtttgttgatctgcctgggggaaggtgtggatttcagcccatccctgtatgccttcactcaatactcctttgaaagcataagctgctggaattaaaccagtggttttgatgtgcttggagctgaagataaagtcctgtttgcacactgtaatggtgtatttaaacattttgacaattatcaggtgaaatctttggctgttattgactccgctcctctgtaagtgattgtgtgcggcaggagagtctctccaccacatgactgggccctcacttacaggttaattgacttgtttggtcgctttcttcttaagccacaggagtggtgaaatgcaatttttttcttgtgttctttcgtaacacaccaagacaaacaaagctgagttttaaatcctgttgcatttattaacttttgagggtctagctatgagttttcagaaacaacaaccaaccaccagctcttctgatcttggtttgaatctctatgatctgagataaattaggttccccccaaaaaaacacacccccaccccaagttggacactgaatgatgtattgggaatttgtttgatacaataaatgtccactatttatttatttattttttgagatggggtgtctgtcacccaggctggagggcagtggtgtgatctcaactcactgcaacctccacttcccagtctcaagtgatcctcccaccttagcctcccgagtagctggggctacaggcctgtaccaccatgcctgactaattttttgtagaggcggggtttcaccatgttgctcaggctgtcttcaactcctggattcaagggatctccccccaacccctgagatggcatcttgttctgtcacccaggctggagtgcagtggcaccatctcagctccctgcaacctccgcctcccaggttcaagtgactttcctgcctcagcctcccaaggagccgagataacaggcatgcagcatcatgcctggctaatttttgtatttttattagagacgagctttcaccttgttagccaggctggtcttaaactcctgacctcaagtgatctgcctgcctcgacctgccaaagtgctgggattacaggcctggactcaagggatctgcccatctcagcctccaaaagtgctgggattcctggcgtcagccgctgggcctggcctattatttcttatgagtctttgggtggttgcatggcccttctgttggtctcacctgggtttgctcatgaagctgcacgtggctgaaggctcagccgggacagccaggtggctaagtctctctcattctgtgggttttctttcagagtttcttctggtgtggtggtcttggggcagagttccaaaagagtgaaaatggaagctgcaaagtttttcaaggtataagctctagacgtgtgcagcgtctcttctgccccactatgtggttaatgtaggtcccaagaagctccacgtgggtttaaatcatgttggtcttttcagggctgtatcctcagtatctagaatagagcctggtacatagaatatttattgatgcaactgagattatcatagtgtatttttctgtgagcacagcagcttattcacagcagcagtttcctaaatggtggctattttattatagctttcctaggggagacacataatgtaaattttctgttatttcttttcttttttttttttttgagacagagtctcgcttagtcccccaggctggagtgcagtggtgcgatctcagctcactgcaacctccgcctcccaggttccagtgattctcctgcctcagcctcccgagtagctgggactgcaggcaccggccaccacacccagctaatttttgtatttttagtaaagatgagggtttcactatgttgaccaggctggtctccaactcctgacctcaagtaatccacccgcctcagcctccgaaaatgctggggttacaggtgtgagccactgcgcccggcctcagttatctgctatttctaggaatactttaggttggcacagaatgaacactgatcttaactgctttccccaaccttcccccaattcgctgttatctgatactcagtaaactgccagagatgcattaccaaaataatatggaggtggtcaaaatcatcatgaagaatgtagacatggaatctgtttgcctgcgttcaaatcccggccccacctcttactcgctgtgagaccttggatgagtcatttaaacgctctatgcttttgtttcctcatctgtaaaataggcttaataattgtacgtatttcctgagattgataaaaattaaatgggttaatatttgtcaagtgctaacaagagaggttggcatgcagtcactgttatgtaagagttaactatcattataagtaacgcacaggccctgactttgagtttccaatgagtcactttcttcagataccacaaaaacttttgggagatattgttctctgcctcatctgacagtcttctgggaattaggaagccatcaagatgaactctgagcaagagtgaaagcagttcatgactggatagctttaattcacctgcttctaatttcatccatggtgtatagattgttaactgtggttttctatcaatagatatgaattagaatgccttttatggagaagtcagctttacagacttaaatagaaaaataaggctggatgtggcggctcaggcctgtaatcccagcattttgggaggccgaggtgggtggatcatttgaggtcaggagttccagaccagtctgaccaacatagtgaaacacatctctactaaaaacacaaaaattagccaggtgtggtggcacgtgcctgtaatcccagctacttgggaggctgaggcaggagaattgtttgaacctgggagacagaggtggcagtgagccaagatcatgccactgcactccagcctgggtgacagagcaagactctgtctcaaaaaaaaaaaaaaaaaaaaaaaaagaaagaaagaaagaaaaaggaaaaattatagcaggagctttcctttattgattattattatttcattatgaaaaaatctaacatacaaaaggagagaaaatagtatcatcatctcccttgtccattatctggtttctacaattatcagctcaagtgggcacagtggctcatatctgcaatcccactgctttggtaggttgaggcaggaggataatttgagcccaggggttaaagaccagcctgggcaacatggcaagaccctgtctctacaaaaaatttaaaaattatctgggtgggccaggcacggtggctcacgcctgtaatcacagcactttaggaggtcgagacagctggattacttgagctcaggagtttgagaccagcctgggcaacatagtaaaaccccatctctaccaaagatacaaaaattagccaggtgtggtcgcacacgtctgtggtcctagctacttgggaggctgaggcaggaggatcacttgagcctgggaggcagaggttgcagtgagccaagattgcgccactgcactccaacctgggtgcacaccatccaaaaaaaaaaaaaaatcagctgggcatggtggcacacacctgtagtctcagctactcaggaggctgaagcaggatggggatcacttgagcccagaagttggaagctgcaatgagctatgatcccaccactgcattccagcctgggcaacaaagcaagatcccgtctctaaaagaaaaataaaaacataaaaaagatattgacaattagcaatttaggggcaatcctgcttcatctttccctccactcttgttcctgctgcttggattactttgatgcaaatctcagctatcacaccactctgtggatacttccgtgtgtatctctaaaaaataaagactcgactttggtcataatcacaattctaatatcatacattttaaaagttaacaatggccgggcgcggtggctcaagcctgtaatcccagtgctttgggagcccaaggtcggcgtcaggagctggatgtggtggtgtgtgcctgtaatcccagctactcaggaggcggaggcaggagaattgcttgacccgggaggcagaggttgcagtgagctgagattgtgccactgcactccagcctgggctacagagcaagactctgtctcaaaaaaaaaaaaaaaaaattaacaataattcctaatgtcatcaaatatgcaggtacttgatatattcaaatttcccagctgagagcatttctttgctgaactctttgtaccctgtaacattgggactcactccctgacgtccagcgattggatgctgtgtcagagaacacaaggaacagtagagcctgtgtttacctttatttatcaatgcaatttttcaacaatttatgagaacagttgccagaaaattatgcggcacatagacagtgttatagttaatctactggctaagggatgcccaggtagctggtaaaacatttccaggagggtgtttccagaagggattagcatttgaaacaatagactgagtaaagaagaaccttgctcgccagcatgcatggacatcacccaatccttgagggtctgaattgaagaaaaaggcagagggaggatgaattctctctctgtttcagctgagacatccaccttctcctgccattggacatctcgggccttctgacttggaccaggacagatgctgttggctcccttggtcctcaggctttcagattcgtactggaaccgcatcaccagctttctcgggcctccagcttgcagatggcagatagtgggacttctccgcctccataatcctatgaatcaatccctgtaataaatctcttcctgttcataactatctatctatttatctgtctatctatctatctatctacctacctacctacctattatctgtctacctatcgctgatttttttttttgagatggagtctcactctattgctcaggctggagtgcagtggtgtgatcttgcctcactgcaacctctgccttctgggttcaagcgattctcctgcctcagcctcccaagtagctgggactacaggcatgtgccaccacgcccagctaatttttgtatttttagtagacatgaggtttcaccatgttgcccaggctgttttcgaattcctgacctcaggtgatccgcccatctcagcctcccaaagtggtgggattacgggcattacctatcatctatttatctctttattatctatctatctatctatctatctatctatctatcatctggtatctatcacctatctcatctatgatctatcaatctattatctatcatctatctattaatctattatctatcaatctatcacctatcaatctatttctattatttatctattataaatcaatctattgctctatctgcctatcatctatttatcatctatctacctatcatctatttatgtacctatctacctatcatctatttatcatctattatctatcacttatctatcatctatcaatctacacttgattttagccaaaaggccaagaggcgatctatctatcatctatcaatctattatctatcatctattaatataattatctatctatctatctatctatctatctatctatctatctatcctactggttctatttccctggagaaccctgactaacacaggcggtaagtaagttgtagtggtaactgggtttgagtctgcctcctccactcctcaaccacttgaatctctctatgccctgccttagccacctatgaaatgggaataattacagcaaggccaactcttcttcttttttggagacggagtctcactctttcacccagcctggagtgcagtggtgcgatttcagctcactgcaacctccgcctcctgggttcaagtaattctcctgcctcagcctccggagtagccggctaatttttttgtatttttagtagagacggggtttcaccttgttgcccaggctgatttcaaactcctgagctcaggctaaccgcctgtcttggccaagtcttcttaatgtctgttcagcatctcttctccctgtcttccttttgtcactggaacccccccataggatgccctaacacacagattttggtatgagtgtgttcggccccatctaactgaggatgcatcggagaggtcagatgtgcacattcactgtgaagggacagccttgaacgtggacccacacaggggtgattactggtgatgaaaactcccttgagttttactgagttgcattgccagaagtgacatgattgtctaaagtagtgaacaagttttggtaatgttccaaacaaaagaaagtacaggcttcctttaatttatacagaagtgacctttgtggaaaattcaataatattgtcttaagtctgttttttgttgcttataacagaaataacataatacataaaacttggtaatttataaataaaaggaattattacttttttaatttttaatttatgtgggtacatagtaggtacatatatgaggaattatttcttacaattatggaggctaagtcccaggctcgaggggctgcatctgatgagtgccttcttgctgttggggactctttgcagagacccaaagaagcacagggcatcccatgaagaggggcctgagcagctacctgaggtctctcttcttcttcttctaaagccacaagtcccactctatgacaactcattaatccatttacccattaactcattaatctattaattcatgaatggatgaatccattcatgagagctttcatgacccaatcacttctgttttttgtttttctgttttttttttttttctttttgagacagagtcttactctgtcacccaggctggagtgtagtggcacgatctcggttcactgcaacctccggcctccttggttcaagcaattcttctgactcagcctccccagtagctgggattacaggcatgcatcatcatacctggctaatttttgtatttttagtagagatgagggtttcaccatgttggccaggctggtcttgaactgacctcaggtgatctgcccgcctcggcctcctaaagtgctgggattacaggtatgagccactgggccaagcccaatcacttcttaaaggctgaacctctcagtactgccacattgggtattaagtttcaacatgaattttcaaggggacagtcaaaccatagcagatagaagtgtgcaaaaaaacgcaatcagaccaggtgcgatggctcacgtctataatcccagcactttgggaggctggtgggtggataacctgaggtcatgagttcaagaccaacctggacaacacggcaaaaccccgtctctactaaaaatacaaaaactagccaggtgtggtggcgcctgcctgtagtcccagctactcaggaggcagaggcgggagaatcacttgaaccaggaggcggagtttgcagttagctgaaatcatgccactgcctgggcgacacagcgagactgtcacaaaaaacaaagaaacaaacaaacaaatgccttttttaggaatgaggaagacacagagagttcatacatgtgcccaaggccacattaagctcctaactgctataaactagctgcctaaatagaaagaatgttctagaaggacagagcagaaaggctcagagtggttacctctgaagaagggtgaaggaaagggtacaaggagaaggctgggtgtggtggatcatgctcataatcctagcaccttgggaggctgaggcaggcagatcgcttgaggccaggagtttgagaccatcctgggcaacacagcaagactctctaaaaaataaataaatgctagccaggcgtggtggcgcatgcctgtaatcccagctactcaggaggctgagtcaggagaattgcttgaacccaggaggcggaggttgcagtgagccgagattgcaccattgcactcccgcctaggcaacaagagcgaaactccgtctcaaaaaataaaaaataaaaataaataaataaataaatacaacttaaaaataatataggttaactataatacctaataaagtttgacatttacctactgctgacccagtaattccactcttggattaagagaaatgtgtgcccatgtccataaaaatacttgttccaggccaggtgtggtggctcatgcctgtaatcctagcactttgggaggctgaggagggcggatcacctgaggaaaaaaattagctgggcgtggtggtgcgcgcctgtagtcccagctactcaggaggctgaggtaagagaatcgcttgaacccaggaggtggaggttgcagtgagctgagatcttgccattgcactccagcctgggcaacagggcaagattccatctcaaaaaaaaagaaaaaaaaatttgttccagaatgttcatagaagcttgtttcataatagtccaaactggaaacaaccaagtgcccgacaacaagagggtaaacaaatgatggtatggtcccaaaatggaattctactcaacaacagccaggaaagaattactggggcatccagcgtgactcaatctgaaaagcattatttgagtgaaagaagccagatacatgagttcatgccggatgcagtggctcacgcctgtcatcccagcactttgggaagctgaggcaggtggatcatttgaggtcaggggtttgagaccagcctggccaacatggtgagaccatgttcctacaaaaaataaaaaaattagccaggcgtggtggcggacacctgtaatcccagctacttgggaggctgaggcaggagaatcccttgaacaagggaggcggaggttgcagtgagccaagatcatgcctctgcactccagcctgggtgacagagcgagactctgtttcaaaaaagaaaaaaaagagttcattctgtatgattccatttatgtggagtctaagaatagagaaaactaagggtgataaaggtcaggatagtggttatcttgttttgggaaggggcaagagggaactttctgggggatggaaatgttctgtgtcctaggggatgtttggcactgtctggagaggtttttgattgtcacaactggtggtgggggtgctactggcatttagtgggtagaggccagagatgctgctaaactgaatcttacaatgcacaggattaccccaaaacaattatctggccggaaatgtcaatcgggctgagagtgagaaattttggtatatgatttaaattgcttaaacacgatcaaggcatttctgcatccttgtgggcatttgccattactacaggcaatatttgagtgacggagacggctagttatccttaggatatagagttgtcattggaaagcagccagggacaatatttcccaatcccctttgcatctgggtacagcctgtgattcattctgcaaatagaatgtgagcaaaagcaatgtgtattagctctgcacaaagcagttgagaaacatgtgcgccttttccattctccttcccctgccaccactggatgcagacatcaacgatgaggccccagggatggaggaaagctgtcagtcaactggcaatgcagcgctagaggagataaacttctattatgcaagcctctgaaatgtgagcgttatttgttacagtggctagcgttactctaatagagtattcaacaaaaaaaatatagtctttgaagggcaggtctcccaaactgatatattaaggggcagttaatctcacttgtaaattctctgagagcagggatcatgtgctacacattttcttaatcttcgataatgctaagtaccatgttgagcaaatgacatgtttctttctctctccttccacccccgcccccaaagtcctatgacttcctgggttggaagagaatgtaagtgttcttttgtaatctttccaggacaccattaatggaaccacagaacaccaactttcacactctaattccatgtgttttggaataagatttactttgccccatgctccagagttgggtcctgattggcttacatcaatcaaagtcttttctttaccctggccttcccactctgtcacccaggttggagtggcacaatctcggctcactgcaacctctgcctcctaggttcaagtgattctcctgcttcagcctcctgagtagctgggattacaggcacatgccaccacgccaggctaattttttgtatttttttagtagagacaggctttcaccatgttggtcaggctggtctcaaactcctgacctcagttgatccgcccgccttggcctcccaaagtgctgggactataggcgtgagccaccacgcccggcctccctggtcttcttgttagggttcgcagatgaacacatcactgagtgagaggcaatgagatccaaggttttatctgggactccggaagggaagcagtttcttccctttcaagagaaagccctgagcatatgcttttctcctgtgtggtggtgtcggtttgggaggcttcagttactacagtaactttgccaccaagagagcaactctttcaagttgtcaaggatccataggtatagatagttctcaggggctcaaatattgtcagaacctaaattctttctctgcctctcttagtgtgttagatattctcactcgtgatgccacgataatgcccacaatttcagacattcaagtcataacaacacgtttctgttaatgagaaaaacctttcccagcgtgcagcggagtttttttcttgtcttattggctagagggcatcacgtgataagcctaaaccaaccactgacaagtggtctggatcaccgtgattggttcatatgtattcctcaggctggggttgggactgggatccatctccctggaagcacatggccagcaggagaggggtggacatctggtcccaaccagaattctcatttaaaaaggaagaaaagtttttgagtaggccaacaataatgtctgctatgtatcctgccatttgtggtggtatatttatcagtcaattgcaagtaacaaaaaaccaaaaagaaaaaagatgttagggagaaatgtattggctggcacaactcaaaagttcagagtttcccagcttcaggcatggctggatctgagcaacaaggtcataattatttggtctctgtttttattgctcatctccgctttattctcaggcagaatcttaccgagtggtggctccagcaactacagacttacttcctaccaagttagcaattccagaggaatcttttaggcaactgttgcaacaaaagtttaagaactgagcctcaaagacttggcttggatcacaaccccattcttgaaccaatcactgtacccagaaggaatgaaaaattctaactggtcaaaccatttcttttttttttttttttttttttttttgagataggtcttttgctctgttgcccaggctggaatacatagctcactgtggcctcaaactctgggttcaagtgatcctcccacctcagcttcccaagtagctgagattagtggtgtgcaccaccacgtctaactaattttttaaattttttgtagaaacagggcctttctatgttggaagagggtcaggcgggcgacttgagaaatcaagcgctctgttttacctgtgatttgtgtttcatatgctgacatacttccggggtcttgagttccttctcccgtgatttttcactggggatgggctgtctgcacgtgcaatgtgtttattggagttgtgtacgtgctcacttgaggcattcttcccttaccagttgaatgtccctagacggtcatcagttaaactttgccattttgcctcttaattcccatgcttgagcccatttacccagtcctgagatcttactgggaagctgctgatcaccagtttcaggttgttgttttttttctgcttattgggagactgcctttccctggagtcggctgagaccaatcattattttagagagatagttaacaaccgcctgagcatcacctgatggtcacctctggtcacctgacattcctggtgtgtgtgtgttgtgggggaactctctcttgctctgttcatgtctgactagctacctactgtaacagctgcaccactgcattccagcctgggtgacagagcgagacgctgtctcaaaaaaaaaaaaaggtgatttgtggcgatggcaaaaatctcaaaggcgttacatgagtcactgaaatttggggaactctgatagacccaggttctatcctggactttatttggctgaaccaaactgaacaaaaattcccttgcatgaaaactggtgctggaggaatattttctttgattgattgattgaggcagggtctcactgtcacccaggctggcattgagtgatggaatcacggctcactgcagcctcaacttcccggcctcaggtgatcctcctgcctcagcctctcaagtagctgggaccatgggcgcacacccagctacccagctaattgatttttgtggggttttttttttttttttgagatggagtctcactctgtcacccaggctagagtgcaatggctcggtctcggctcactgcaacctccgcctcccaagttcaagcaattctcctgcctcagcctcccaaatagctgggactacaggcacgtgccaccacacccagctaatgtttgtatttttagtagagatggggtttcactatgttggccaggctggtctcaaactcctgaccttgtgatctgcccacctcagcctcccaaagtgctgggattacaggtgtgagccactgcgtctggcctatttttgtgcattttttgtagagccaggattttgccatgttgcccaggctggtcttgaacttctgggctcaaatgatcctcccgccttggcctcccaaagtgctggggttacaggtatgagccaccatgtccagcttgaggaaatctttccaaggactgctgccttcaggtggagcttcaaggttcaaacggtctttattcatagcctttttaaatttggtgggggctacatttttcaaatatattttcaaaggccttcatttggggagaggccttaaatgtgccaactgccagctgcaagaaccaagtggccagaacatcgaggttttgaagtctcgcaaaacagatgtgtaaaagtcaactgcacaggcaggaccttagagtggcacccggaacccaaggccttgaaagatcccagcttgtttctttacagaaagcttggctttgttgaccaggctgatagaaaccgcgcccagctgtagaaaggttgcgtgtgtatatatgtgcgtgtttctgcttcctctttttttatctcatacgattacaaacacataatctcaagggtctgcagcacatgtcaccttggagttattttagatttacccccggaacatcaaacgttcattccagaagggtttgacagggcatagagagtgccgactaaacccagagggggcaagttcaagcatgtttttcgctaccccaatttgcatcagtgcctccccacccccccaaaacacatgcctcttttgcattactcagtgaaaagtgaaaactgataaagaaaaggcatgttttgttaattaaaaacatctttatttaatagcatggctgctaaatctggtaaatagcagcatgctgctagatctgaataatggggtcgtttttttctttgacacagggtctcactctgtcactcaaactggagtgcagtggtgcagtcatggctcactgcagcctggaactcctgggctcaagtgatcctcctgcctcagcctcctgagtagctgagactacaggcacgtgcaagcatgcccaggtaatggggtcatttttgtttctttttctttcttcttatttcaaccctattatctgacctttttttttcccttgcaaatattcttgttctgtctcctatgtctggagatggaagataaggaaacccatactagtccttttgggttgctctgatcaaataacagagcaacagacagagaaaacaacagagggagggagggctttccctctttccccctccctccctccctccctccctcccttccttccttccttccttccttccttcctttttttccttcttttctttcttttctttctttttttaagacggagtctcgctctgtcgccaggctggagtgcagtggcgtgatctcagctcactgcaacctccgcccctgccccagggttcaagtgattctcctgcctcagcctcccaagcagctgggactacaggcgtgcgccaccatgcccagctaatttttgtatttttgtattttttgtatattttgtattttgtagagacggggtttcaccacgttggccaggatggtcttgatctctacctcgtgatctgcccgcctcggcctcccaaagtgctgggattataggcatgagccaccatgcccggtcttcttttctttctttctcaattttattaagtgcatcctatggtactatgctgggcataatggaaaccaaaacagaaataatgtctactcagatggagtttaatttctggacaggagtaacaaactgaaatgcataacaggaacctaagatgcactgaatagagctggcttgagaaagataacctgtaatcttcactggcctcagtgtctggaaggcatcagggaatagtgggtaccgtggtaaactggagagcccatgctcctttccagatcctcagatcagccatcaggaaagtagaccctcttttcccatacttttatatacatatttcaaaagaagccagaaattgacagaaattcagatctttatgtgaaatctaccagtattcaaatactgacaactcattcagattatttaaaatgcttgtatgggccgggcgcagtggctaacgcttataatcccagcactttgggaggccgaggtgggcggatcacaaggtcaggagatcaagaccatcctggctaacacggtgaaaccccgtctccactaaaaatacaaaaaattagccgggtatggtagcaggtgcctgtagtcccagctacccggggaggctgaggcaggagaatcgcttgaacccgggaggtggagcttgtagtgcagtgagctgagatcgcgccactgcactccagcctggacaacagagcgagactccatttcagacagacaaacaaacaaaacgcatgtatgggccaggtgtggtggctcacgcctgtaatcccagcactttgggaggccaaggcaggtagatcatgaggtcaggagatcgagaccatcctggctaacatggtgaaaccccatctctactaaaaatacaaaaaattagcctggcatggtggcaggcacctgtagtcccagctactagggacgctgaggcaggagaatggtgtgaacccaggaggcagagcttgcagtgagccaagatcatgtcactgcattccagcctgggcgacagagcgagactccgtctcaaaaaagaaaaaacaacaaccaccttaggttctataggtgatgttatctatagaagcaattgggaaagttacaaatcttgtgacctctggccacatgactcccgagcagtaaaggattatagaaactgtgcctattttatcagaattcagtcccctctcatcctgctaaccttgtggcctttcattagttttacaaagctggtttggttttggggagggctattattatctttgctttaagataaaaccataaactaaattcctcccaaagttagcttggcctatgcccaggaatgaccaaggagtttggaggtcagaagcaagatggagtcaactatgtaaaatttatcttactgtcataatttggcagaggcagtttcaaggtcagcagtgaatggtagccgcagtgtgctatcattgcacctgtgaaaagccactgtaatccagcctggacaacatagcaaggccctgtcttttaaaaaatctattttaaaaaaggctgggcaaggtggctcatgcctgtaatcccaacactttgggagcctgaggtgggcagatcacctgaggtcaggagttccagaccagcctggccaacatggcgaaaccctgtctttgccaaaaatacaaaaattagctggacatgatggcgcatgcctgtaatcccatctactcaggaggctgaggcaggagaactgcttgaacccaggaggcagaggttgcagtgagctgagattgcaccactgcattccagcctgggcgacaaagggggactccatctcaaaaaaaaaaaaagtgtataatcaggcatccaactcaacccgattgactaggactttcctgattttaacactgcaaacctggaaagtcctggacaaaccagaaggagccggtcatcctacttatatggtactcagcatttgccaggcatgaagtccgtgatcagggactgctaacaggcggcgggccaactcacaggccaaatccagccccaccactagttttcttttttttttgaattgaaaaaattttggaccaagcatggtggcttacacctgtaatccccacacttgggaggctgagatgggaggattgcttgaggctgggagtttgagaccagcctgggcaactcagggagatcctatctctacaaattaaaatgagaagtaaataattttgataattgcagattcacacgcacttgtaaaaaataatacagagatctcttttacattttgtccattttcctccaactatgcaaaagcatagtataatatcacattcgggatgttgatattcatatgacccaccaatcttattcagatttctcttatttgtagagatggggttttgccatgttggctaggctggtcttgaactcctggcctcaggtgatctgcccatctcagcctcccaaagtgctgggattacaggcatgagccacctcaccggaccagatttccctttttagctgtactcatttgtgtgtgtattaagttctataaaattttatcacgtcttgtgtgtccaccaccgcagtccagatactgaacagtttcaagaccacagggaccctcattgtgcctttgtataacctcacccacacctctgtcccacagactgcactcccagccctcatccttaaccccctggcaactgctaatctgtcctccagttctaaaatgtcatttcaaaaatgttacaagctggatgtggtggcttacgcctgtaatcccagcactttgggaggccgaggtgggcggatcacctgaggtcaggagtttgagaccagcctggtcaacatggtgaaaccccgtctctactgaaattagccgggtgtggtggcaggtacctgcaatcccagctactcgggaggctgatgcaggagaatcacttgaacctgggaggcagaagttgcagtgggctgagatcacaccactgcactccagcctgggcaacagagcaagactctgtgcccctgcccccctgctccccacacaaaaagttacacaactggaaccatacccaatccccatacagtatgtaattttaggggattttatttccccctcagcataattttctggagattctttctaaccgtcgcacgaaccaacaattcatttctctttattgctgagtagtattccatgatacagatgtaccagtttaactatttacttgttgaagcatatctgggctgataccagtctttggttctgcctcctgtttttatataaagttgtattggaacacagccatgcccatttatttacattttgtctatgactgctccttagagttgaatagtttcatcacagaccatagagcccacagcctaaaatatttactctccagccctttgtagaaaaagtttgccaacccttattccaagcacctaacatttattaatcttaattttcacaatatccctatataattgttatcttcgtttcgcaaagggagaaactgaagcataaagaaagtaagtaatttgctcatagtcacacagccgagctaggttttgaactcagcaatatggctctaggggctgcctcttaaccagtcctcctcaaaagataatcttacttctcagttcaagacagaggaactcggctgggcgcagtggctcacacctgtaatcccaacactttgggaggccaaggtgggcagatcacctaaagtcaagagttccagaccagcctggccaacatagtgaaactctgtctctactaaaaatacgaaaattagctgggcttggtggcaggctcctgtaatcccagctactcgggaggctgaggcaggagaatcgcttgaacctgggaggcagaggttgcagtgagctgagatcacaccattgcactccagcctgggcgacaagagtgagactctgtctcaaaaaaaaaaaaaacaaaaaaccacacacacacacacacaaacagaggaactgaaaactgagataagcacacaagagagctagcagctgaacaacagggcttctctttgagggctagaaggaacggtaggatttaacttgtgatcatttgctttgttacctgaataatgcttggaacagagctaaaatttctcattcatttgaattaatttgatatagggctttttaaattttaccaggattttacaaaggttcaggacccaagtgtctctggtcccctgactttcttcctttctttctttttcagacagagtttcgctcttgtcacccaggctggagttcagtgacacgatctcggctcactgcaacctccgccccccgggttcaagccattctcctgcctcagccttccgagtagctgggattacaggcgcccaccaccgtgcccggctaatttttgtatttttagtagagatggggtttcaccatcttggccaggctggtcttgaactcctgacctcatgatccacccacttcagcctcccaaagtgctgggattacaggcttgagccaccacatctggtcagtcccctgactttcacagccacatttgtaactggaaaattagcacagtcattgttatcttttgcttgtatcccaggggtttttcaggtaagtacagacctgaacctagagaaacttccctaggccagcatgaggctaaatggtggcttttaatggaaatacttttctttcttcttcttttttttttttttgagagggagtcttgcactgtcgcccaggctggagtgcagtggcatgatcttggctcactgcaagctctgcctcccaggttcacgccattctcctgcctcagcctcccgagtagctgggactacaggtgcccgccaccatgcccgactaattttttgtatttttagtagagacggggtttcaccgtgttagccaggatggtcttgatctcctgaccttgtgatccgcccacctcgccctcccaaagtgctgagattacaggcgtgagccaccgcatctggccgcctttcttcatttttgtggggagacttatgcccagctgagagaatttgggtctccctttagggtgaccaactatcatgattttcctgggattgagggggtttctggattgtaggacttgcagtgctaaaacctctgcctcctgggcccaagtgattctcctgcctcagcctcccaagtagctgggattacaggcacatgccaccacgcccggctaattttgtatttttagtaaagacggggtttcaccatgttggtcaggctggtctcaaactcctgacctcaggtgatccacccaccttggcctcccaaagtgctgggattacaggtgtgagccaccacatccagcttgtaacatttttgaaatgacaacattttagaactgaaggacagattagcggttgccagggggttaaggatgagggctgggagtgcagtctgtgggagagaggtatggtggctcatggctgtaatcccagaactttgggattacaggtgggtggatcacctgaggtcaggagttcgagaccagcctggccaaaatggtgaaaccccgtctctactaaaaatacaaaaattagccaggcgggtgtggtggtgcacacttgtaatcccagtactttgggaggctgaggtgggtagatcacttgaggtcaggagttcgagaccagcctggccatcatggtgaaaccccatgtctattaaaaatacaaaaattagccaggcttgatggcgcatttcagtaatcccagctatttgagaggctgaagcaggagaatcgcttgaacccaggaggcagaggttgcagcgaactgagatcactccactgcaccccagcctgggtgacagagtgatactctgtctcaaaaaaaataaataaaattagctgggtgtcatggcacatgcctgtaatcccagctactcactaggctgaggcaagagaatcagctgaactcaggaggcagaggttgcagtgagctgagatcacaccactgcactctagcctgggcaacagagtgagactctgttgggcaaacggagagaaatcagtcaccctagtccaactagtccctgacccagacttggaaggagagggtagatttcaaaagacaaagatatattcattcattttttgagataaggtctcactctgttacccagacaagagtgcagtggtgcaatcatagctcaccgcagccttgaacttctcaagggatactcttgcctcagtctcccaagtagtcaggattcaggtgtgcaccaccccacccagccacaaaacaaagaccaaaaaaagcaacatttcagccctgggtagtggctcatgcctgtaatccagtgctttggaaggccaaggtgggtgggtcgcctgaggtcaggagttcaagaccagcctggccaacatggcgaaaccttgtctctaccaaaaaatagataaaaattagccaggtgtggtggtacttgcctgtaatcccagctactcgggagattgcggcaggagaattgcttgaaccagagaggcagaggctgcagtgagccaagattgcgccgctgtactccagcctgagagagagcatgagactccatctcaaaaaaaaaaaaaaaaaaaaaagaaagtaaaggaatgaaagaatggctacttcataggcacagcagtagcatgggctgctgattggctatttttatggttatttctttctccagcctgggcgacagatcaacactctgtctcaaaaaggaaaaaaagaaaaaaaaagttaccttgccacatattgaaatggccccaggagcctcctcctttctccccctcccctcaacccattacgaaaaaaaaaaaaaacggccctacaaaggcttcttttgtgggggaaaatttgcattgtaaagaatttctatgaatataactagatttttcatcttccaggctctccaaatcctggtgagattaactgagaatctagcatcctgtaaaggtctaaatagaaaacattaaaaaaaaattatagagatggggtctcactctgttgccctggctggtcttgaagtcctgggctcaagtgatcctcttgccttggcctcccgaagtgctaggactacaggcatgagttaccatgcccgcccaacaaataggaaacatttgtcctctattgtctcaaagggcagccacctatgagacttcatctacttcatacaaaccttggtctccatagccccttattgtaacccagacactcctttcttttgattctagatctctagatagtaacttaactttcagccaattgccaatcagaaaatctttgaaaccacttgttacctgtaaataccctcgcttactttgagttggtccacctttctggactgaaccgatacacctcacatgtattcattgatatcttatgtcctcctaaaatgtataaaaccaacctcaaagggcgggtgcggtggtttatgcctgtaatcccagtactctgggaggcggaggtagacagatcacctgaggtcaggagtttgagaccagcctggccaacatggtgaaaccctgtctctacaaaaaataaaaaattaggccaggcgcagtggctcacacctgtaataccagcactttgggaggccaaggtgggtggattgcctgaggtcaggagtttgagaccagcctgaccaatattgtgaaatcctgtctctactaaaaatacaaaacttagccgggcatggtggcgtgcacgtgtagtcccagctactcgggaggctaaggcagaagaattgcttgaacccaggaggcagaggttacaatgagccgagatcgcaccactgcactccagcctggatgacagagggacactctgtctcaaaataaaaaaataaaataataataaaattaattaattaaaaaattagctgggtgtggtagtgcacacctgcagtctcagctactccagaggctgagacgggaggattgcttgagcccgggaggtggaggttgcagtgagctgagattatgctactgctctccagcctggatgacagagcaagaccctgccccccacccatccccccaaaaaaagtcttctgctagccatcatcactcatatttggctcagaataaacctctttaaatattttgcagttcagctttttcaacacctccaatttgaacttgtctgattgtatccacaggtttagattcaggttgaatatttttggcaaaaatactataaaagtgatattgtgtgtgtccttcttggggaatgatttttattatactacgttttaataaatttacttttagccgggcatggtggctcacgcctgtatcccagcactttgggaggccgaggcaggtggatcacctgaggtcagttgttccagaccagcctgggcaacatggtgaaaccccatctctactaaaaatacaaaaaattagccaggtgcggtggtcggtgcctgtaataccagctacttgggaggctgaggcaggagaatcgcttgaactggggaggcagaggttgcggtgagctgagatcacgccattgcactgcagcctgggcagcaagagtgaaactccatctccaaaaaatatatattttttatttatttacttttcatttatttaagaggggtataacatcacatggaatctttgtccagtggccttagcaggaagattgtttcagaatttggcatgaactatgcccataattccatgggtctgagttacctttcctcacatcactctggttttgttcagtttgctgccgggagtcactgtcctgttctttgctttgtatgcataagcgcatctcttgcccaaataggattcagtttcatctcaggcataaatgccttcaatgttaagaagagctgtgtactccctttggttcaagagaccctgcttatagccagcaaaagtggccttgggtccaggcccagtggttcatgcttgtaatctcagcactttgggaggcctaggcaggaggatcacccgaggccagtaattcaagaccaggctggtcaacatagtgagaccgtgtctctacaataaaaagaaaataaagccaagtgcagtggctcacgcctgtaatcccagcactttgggaggccgaggcgggtgtatcacctgaggtcaggagtttgagaccagcctgaccaacatagtgaaaccccgtctctactaaaaatacaaaattagctgggtgtggtgtcacatgtctgtaatcccagctactcgggaggctgaggcaggagactcacttgaacacaggaggcggaggttgcagtaagccgagattgtgccattgcactccagcctgggtgacagagtgaaagtccgtgtcaaaaaaaaaaaaaaagaaaaaaaagtaaaaggaaaaaaggaaaaatggccttagaccacagccttccagacatatctgccttttagaagtcctgtcctggttgggcagggtgtctcatgtcagtgatcccagcactttgataggccaaggcgagaagatcccttgagcctaggatttagagaccagcctgggtctctaaatataacataaggagatcccatctctacaaaacactaaaaaaagttagctaggtgtggtggcatgcacctgtgttctcagctactgaggaggctgaggttagaggatcacttgatcctgggatgctctaggttacagtgagctatgatcgcaccactgcactccagcccgtgcgatggagtgagaccttgtttcaaaagaaaaaaaaaaaaggccctgtcaagcagacaggctccaagatggtagaaagagaaaggccttagggaatgatttttaaatttacggcagctgagagtctaacttcttagagggggaaaattgtgaaatactaaaatgtgaaggtgaaatcccttgcccaaggtcatatgtgccttttagttggtgaccccagactctaatcctggtctccttgtctgtctgtacctatgtgttcttctgtcttctctgttcttagaaacaaactttttcctccccccacctacagcatgccttctgtggtcagaattctgctttaaaaagcctttttcccttattacttttgcacacaactcagttctctccaacaaggcctgaactgccattgtttgcttcaaacttccttgcatccaatccttcctcttttcaagataaggcctgtttttcccagggctctggggaaccacacctagaagaggctgttccagacaagtctagcattgcttccctttttctgataaggttccattgttgagaacactccctttgtttcttacctgtctccaaaacattctggaatttacttctattttagtttgctgatgtggccattactgttaagtggtggttaattatctttgtattctacattctttttttttttttttttgagacgagtctcactctgttgtccaggctggagtgcagtggtgcgatctcggctcactgcaacctctggctcctgggttcaagtaatgctcctgcctcagcctcccaagtagctgggactacagacgtgtgccaccatgcccagctaatgttttgtatttttagtagagacggggtttcaccatgttagccaggatggtcttgatctcctgaccttgtgatccacccgcctcccaaaatgctgggattacagccgtgacccgcagtgccagcgagaattcgtatttctaacctaacctaatctaatctaatcaagtgattctggcccacagataacacttagagaatcactgggagctgggtgttgtgatttgtgtctgtaatcccagcactttgggaggccaaggcaggaggatcccttgaggccagaagttggagaccagcctggacaacacagcaagacctcatctctactaaaaatttaaaaagtagccaggcatggtagcatgcacctgtagtcttaactacttgagaggctgaggcaggacgatggcttgagcccaggaatttggctgcagtgagctataatcacaccactgcgcttcagcctgggcaacaacagagggagaccctgtatgttaaaagaaaacaaaacaaaaaaatcattggcttaaactgacatttatataatgtcaaactgattaggctgggtgcagtggctcacaccttgagctttggaaggctgaagctggcagattgcttgagctcaggagttcaggaccagcctgggcaacatggtgaaaccccatcataaaaagaaagaaagaaagaaagaaagaaatacaaattctcagctcttcttccttcctttccttccttccctcctttcttccttccttcctccttctttcctttcttcctccttcctttcttccttccctccttccttctttctctctttccttccttccctccctcccctcctctctctctctttctctttcttccttccttccttccttccttccttccttccttcctttctttctttctttttctttctttctttctttccttctttgccttccttccttccttctttccttccttccttccttcctttcttcttttcctttctttcctttatttcctttatttttctattgacaggatcttgcgctgtcactcaggctggagtgcagtggtgcaatctcactgcaggttgctcactgcaaccttctcccccaggctcaagcaatcctcccacctcagcctcccgagtagctgggactacaggtgtgcaccaccatgctggctattttttggtatttttagtagagatggagtctcattatgttgcccaggctggtcttgaatttctgagctcaagcgatccgcctgccttgtcctccaaaagtgctaggattacaggtatgagccaccatgcctggccaaaaccccgtctctacaaaaaatacaaaagtagccaggtttggtggtgtgcgccagtagtcccggctacttaggaggctgaggtgggaggatagattgagccagagagatcgaggctgcagtgagccattatcccaccactgtactccagcctgggtgacacagtgagacgagactgtctcaaaaaacaaaaacaaacaaactgattatattgaagtatcataaagcaagttatagacatgaagtcacccacaaaacctaaaaatgtccacttcccaggggttcaattctctactttctcttgctgtccacatctaatctgttttgaagtttttcttgtctagcttcaacatataccctgaacccccatcctttctcctacatcgtcttagcccaagctcatatcccctctcgcctagaataccgcagccacttctcatctggtatcctctcccagtcttgacccaactccccacacagtcacaggggttatcgttggaaaatgcaagtcagatcatatcactctgttaaaaacacatccagtggctactgcaattagaataaacggcaaacttcttttatgactgacaagaacctgcatgcccagaccctgcctgtctgtctggcattctcgttgcttcttgagccttgtttatcacgctcaggtttactggcgtcttcctctttctgcacatatcaaactcttggtacttgtaattgtctggattgtaccccactcccagcctgaattctgtgcttgacaaaaggctaccttttctatctacttacctaaagaaagtgaagaaatgtctaagatgtgctggtaggtgaaaaagtaaggtgggaagtacgtattgcatacatgttacctttttatttatttatttatttgagatggagtcttactctgttgcccaggctggagagcagtggcgtgatctcagctcaccgcaacctctgcctcctgggttctagcgattctcctgcctcagcttcccaagtagctgggattacaggcatgcactatcatgcctggctaatttttctatttttatttttcatttttatttctatttttttgaaacagagtctctctctgtcgcccaggctggagtgcagtggtgcaatcttggctcactgcaacctctgcctcccgggttcaagcgattctcatgcctcagcctcccaagtagctgggattacaggcacgtgccaccacaccagctaatttttgtatttttagtagagatggggtctcgccatattggccagactggtcttgaactcctgacttcaggtaatccacctgcctcagcatcccaaattgctgggtttacaggcgtgagccactgcacctggcctaaaaattttgtagagacaaggtcttgctatgttgtccaggccagtctcaaacttctagcttccaatgactcccacctcagcctcccaaatactgggattacaagcataagccactgcacctggcctctatgttaccattcaggagatatatagccctttgcttgtacatgattcaactacttctgaaagcatacacaagaaacagttaactcttgttgtctctagggaaagatgctgggtgtctagggaagagtggaagaaagatttttaccagaaatcttttgtaccttttggattttgaaccacattatacctggtcaaagtaaattaacaaataaataccatcaagactaactagttaaataagtagttctgtggttattctgtgcctgtcacaagctgttttttttttttttttttttgtagcactgattacaatctgtaattatcttgcttttgtgtatgtgttaactgatgttttgtccccgtccccgctggattacaaagtcctgagaagagagactgttgctgtttgtgtctcaccattacatgcctaagaattagcacagtgcctggtaaacggcaggatgtcaacaaatatttctctgggattttttggtttttgttttttctgagacagagtctcgctctgtcgctcaacctggagtgcagtggcgcaatctcggctcactgcaacctccgtcccctggttcaagtgattctcctgcctcagcctccccagtagctgggattataggcacccgccaccaagtctggctaatttttgtatacatacatatatatatatatatatatatatatatatatatatatatatgtattttttttttttaagataggatcttgttctgtctcccaggctggagtgcagtggtgctatcatggctcactgcagcctggaactcctgggctgaagtgctcctccggcctcagcctcccaagtagccaggactacaggcatgtgccaccatacccagctaatttttttttttgagaccgagtctgttgctctgtctctcaggctggagtgcagtggcgcgatctcagctcactgcaacctctacctcttgggttcaagcgattctcgtgcctcagcctcaagagtaactgggactacaggcacgcaccaccatgaccagctaatttttgtacttttagtagagatggggtttcaccatgttggccaggctggtctcgaactcctgacctcaggtgatctgcctgccgcagcctcccaaagtgctgggattacaggcatgagccactgcacccggcctcccagctaatttttgcattttttgtagaaatgcggtttcaccatgttgcccaggctggtctcgaacttctgggctcaaatgatccttctgccttggcctcccaaattgctgggattatagggatgagccactgtgcctggactgttttttttgttttgtttttttttttaatatgaaacacttcatgaatttgcatgtcatccttgcacaggggccatgctaatctttgtgttattccaattttagtatatgtactgcagcagggagcataaatatttgttgaatgaatgaatcttgtccagcagggacgaagtggaaaggaaggtgcaatacaatcacttgtggattcaggatctgcatacctgaccggcagacctgcttgctggcttggaacctcctgaagttcatgactgtctaatgaattctgaatcagccatcctctgcaatttccttgctatgtcggagtcagcgagattctattacctgctctgggccttaggtttcatgcctgcaaaatgggccgagtgaaatagatctgtgtttgcctaactggagttgttcctgttctatctttatgatttttgccatatcgtctatattatttagcatttttatatctgtaccatctatattatttacttaacatttttcttgcatcggttcacttatttttagctatataaatattatttcaaaaggaaaccttatgtcaatacataagcagaaaacctatacctcttgccataaatgggagctagaagtaaaaataaagacagtgaaacaacacaatgtgattacatgctggctagagactgttgcctgtacaggctttagggtccagatctgcttgtcctttgtcataaaggagattgggctgggggtggtggctcatgcctgtaatcccagcactttgggaggctgaggtgggagaatattttgaggtcaggagtttgagatgagcctgggcaacatagggagacccttgtctctacaaaaaaaaaaaaaaaattagcagggcataatggcacctgcctggggtctcagctacttgggaggctgaggtgggaagatcacttgaacctaggaggtcgaggctgcagtgagccacgattgtgccactgcactccagcctgggcaagagagtaagaccctgactcaaaaaaatcaaaaacagaaaaggagattgtaccacactgagacttcctactagaggtagaattagaagaggattgaaaaaggggtgactgaggccgggcgtggtggctcaagcctgtaatcccagcactttgggaggctgagatgggtggatcacctgaggtcaggagttcgagaccagcctggccaacatggtgaaaccccatctctactaaaaatacaaaaaaattagccaggggtggtggtggtgcctgtaatcccagctactcgggaggctgaggcaggagtgtcgcttgaacccaggaggcagaggttgcagtgagccaagattgcaccattgcactccagcctgggcaatgggagccaaactccatctcgaaaaaaaaagaaagaagaaagaaagaaagagagagagagagagagagaaagacagaaagaaaaagaaagaaagaaagaagagaaaagaaagaaaggaaaaggggtgactggctgggtgtggtagctcacggctctaatcccagcactttgggaggctgggatgggaggatcacttgaggccaggagtttgagaccagcctgggcaacatcgtgagacccccccatctctacttaaaaaaaaaatgaaagagagattcctttccacagtgctttttaatggtgcccgaatattttaccaaaaataatctcatctacactaggggaaacattgagtttaaattgctcatttcacaaacgtagaaactgaggcccagtatgggggttgaaattttccagggtagtcatttgggaatttgtcaagtctggactgtaagctttcataataggaactgcattggcatgtgcttgggacaggtctggtatacagtgtcattcaataaatgagtcctgagccaggcatggtgacacatgcctatagtcccagctactcaagaggctgaggctggagggtcccttgaacccaagaatttgaggttgcagtgaactatgattgcaccactgcactccagactaggctacagagtaagaccatgtctctagaaaaaaaaaagtaataataaataagaaaaaaagagaaagaaattagttttttttttttagagacggagtctcactctgttgcccaggctggagtgcagtggtgtgatctcggctcactgtaacctctgcttcccgggttcaagcaattctcctgcctcagcctcctgagtagctgggactacaggcgcatgctgccacgcctggctaattttttgtattttagtagagacggggtttcaccgttgttgcccaggctggtctcgaactcctgagctcaggcaatccacctgcctcggcctcccaaagtgctaggattacaggcgtgagccaccgtgcccggccagaaattagtttttattttatttatgtatttattcatttattttgagatggagtctcgctctgtcccttggctggagtgccgtggcgcgatctcggctcactgcaagctccgcttctggggttcacgccattctcctgcctcagcctcccgagtagctggaactacaggtgcctgctaccatgcccagctaatttttttgtatttttagtggagacgggggtttcaccgtgttaaccaggatggtcttgatctcctgacctcgtgatctgcccacctcggcctcccaaagtgctgggattacaggcctgagccaggttctttatcaaacctgcttgttttttgtttttttttgttttttatgatattattctgtttgcatattttggtaccttcttttgtgtctttaataattattagctcatctttcgatggtttttgtgcaaacatgctattatctgaaagtacgcctttgcttgctgggttgactcctagctccaggaggatgatttctatattgtaattttggattacatgagccccaaggcctgatttcctgcccttgtatttgcattgcattaggaggtctttgctttctgagacccgtgacacctcctcctctggcatagtatctatcagttcacactaccggttgggtttcagttccatttttgttttttgacatgggggatttccctttctttcctgtgaaccctgtgattcatttaaaagagtacttgttatcttttactcagaatttccagatgtttttgcgggtggggttgagtgtttcaggctatctaatctgctgtattgctggaaactgaccacctttgcgctttttttagtttcttttctctaccccctagctctgaatattcagtttctgttctttcatttcccaccctactccctcctgtctcatatatcttttataccttcagcttcaaatccttttcttaacaagttgatttactctggagtttctaatttaaatgcatcccaggtggcaatctcacaggtcaacctggttcctgttgggccagatattctgggtccagctatctcataaatcacttgccctgcccatgcattggctgcccctggggctgatgcccatgtctgacacaatcagctgtggtgtgagcagaagttgccagtcacatggtaccaaagaaggtgacttctgctctgtctttagaagggtctgtgggtaagtggggcagacatcatgactgacatgtacagtaacatccttaacaggtttgcaatgtagttgattgataatagccagaaggtttaaaatatttttttttttgagatggagttttgctctttttgcccaggctggtgtgcaatggcgcgatctcggctcactgcaacctctgcctcccaggttcaagtgattctcctgcctcagcctcccgagtagctgggattacaggcatgcaccaccaccctggctaattttgtatttttagtagagacgggttttctccatgttggtcaggctggtcttgaactcctgacctcaggtgatccgcccacctcggcctcacaaagtgctgggattacaggcgtaagccaccacgcctggcaaatttttattttttttaaagctagaatcttaacttgccttatacattcacctctggcatagatactgtttgcatgccccaacatggctactccttccatgttcctactctgtaagtactaaatcattgatagagggtttgtcctctcaaataagcttactgtcatcactttaaaacactatttcttttctttacttttttttttttttttttgagacggagtttcactgttcttgttgcccaggctggagtgcaatggcacggtcttggctcactgcaacctctgcctcctgggttcaagcaattctcctgcctcagcctcctaagcagctggaattacaggcacccgccaccacgcctggctaatttttatatttttagtagatacggggttccaccatgttggccaggctggtctcgaactcttgacctcaggtgatccgcccgcctcggcctccctaagttctgggattacaggtgtgagccaccgcacctggtccccgaattcattttttaaaaaaggaagtgttttattccagggctggagtcagccaacctttaaatgcccccgaaactctatatgatgggataccatgtagccagtgaaacattatgaagctgcttaacattcaacagttaaaaaagatctcccagatactttacttttaaaagaagttgtggatacattgtaggtgtatatatcaatggggtatacaggatgtcttgttacaggcatgcaatgtgaaataagcacatcatggagaatggggtccagatactttaagttaaaaaaaaaaaaagagataaagcagtgtgtataataggccttattttgtgttacaaaaatgtatatatatatagaccagatgcggtggctcacgcctgtaatcccaacactttgggaggccaaggcaggcggatcacttgaggttaggagttcaagaccagcctggccaacatggtgaaaccccggctctactgaaaattaaaaaaattagctgggcgtggtggtgcacgcctgtaatcccagctacttgggaggttgagtcaggagaattgcttgaacccgggaggtggaggttacagtgagcagagatcacgccactgcactccagcctgcgtgacagagggagactccatctcagaaaaaaaaaaaaaagaatatatataaatacgtgtgtgtgtgtgtgtgtgtttatttgtaaatgcatctcttaaataatacctaagaaattggcaatggtggctcctctggaagaggaagtgggtggctgagggacttacatcgcatttcctttgtagaagttaaaaataaatgaagaggctgggcgcagtggctgacgcctgtaatcaaagtgcaagcagcagtttgggaggccaaggcggaaggatcacttgaggccaagagttcaagaccagcctgagcaacatagtgagaccttgtctctacaaaaaaattttaaaaattagctgggtgtggtggtatgcgcctgtagtctcagctactcaggagcctgagaagcagtggaatagtttgagctgcggtgagctatgactgtaccactgtactccagcgtgggtgacagagcgagaccttgtctctaataaaataaaaaataagggcagggtgcggtggctcacgcctgtaatcccagtactttgggaggccgaggcgggtggatcacctgaggtcaggagttcaagaccagcctgggcaacatggtgaaaccccgtctctactaaaaatacaaaaattagctgggtgtggtggcatgtgcctgtaatcccagttactcgggaggctgaggcaggagaatcgcttgagcccaggaggtggaggttgtagtgagccaagattgcaccattgtactccagcctgggtgacagagcgagactctgtctcaaaaaaaaaaaaaataaaataaaataaaaggaaggaggaaaaaagaaaggaaagaggaagagaggaggaaaggaaagaaaatattgtctgggtacagtggctcatgcttgtaatcccagcattttgggaggctgaggcaggcagatcacctgaggtcaggagttccataccagcctggcaaacatggtgaaacaaaaattagccatgtatgctggcacacgcctttaatcccagctactcgggaggctgaggcatgagaatcacttaacctgggagatggaggttacggtgagctgagatctcgtaacactgcactccaacctaggtgacagagcaagactctgtctcaaaaaaaaaaaaagaaaaagaaaaagaaaatgggcccggagtggtggttcactcctgtaatcccagcactttgggaggctgaggcgggtggatcacctgagatcgggagttcgagcccagcctgaccaacatggagaaaccctgtctctactaaaaatacaaaattagccaggcgtggtggtggacgcctgtaatcccagttactcgggaggctgaggcgggagaatcgcttgaacccgggaggcagaggttgtggtgagccgagatcatgtcattgcactccagcctggacaacaagagcaaaactccgtctcaaaaaaaaaaaaaaaaaaaagagaaaatgtaagaatagctcctaagccaagctgggaaaatatttgctgaagaatggcaacacctcacatttatctgtctctagaaaaaggcaagggttaagtcagttcctcaaaaaggccacctcagaagccatggcctttccactggcagtacttctctcttgactttacccttaagaggaattgggatctcagatctatataccaagcctggcccatatgtttgaggtcatgaaaaagaatgtgggggccaaaaattcatcctcctagctcagtgtcttcaagcctttggctgaatcgcagaacagcaacaaacatatttcacattgtgattcagtattgacacttgtatttctttctctttttttgagatggagtttcactcttgttgcccaggctggagtgcaatggtgcgatctcagctcactgcaacatctgcctcctgggtttaagcaattttcctgccttagcctccagagtggctgggattacaggtgcacgccgccatgcccggctaatttttgtaggttttttttttttttttaagatggccggctaatttttgtatttttttagtaaagatggggtttcatcatattggtcaggctggtctcgaactcctggcctcaggtgatccgcccaccttggcctcccaaagtgctgggattacaggcgtgagccaccacgtctggcctatatatatacatatttgtaacacaaaaaaaggcctattatacatactgctttaccttttttttttaacttaaaagtgtctgaaccccattctctgtgatgtgcttatttcacattgcaaaactgtaacaaaacatcctatgtactccattgatatatacacctacaatgtatccacaactttttttaaaagtgaagtatctgggagatcttttttaactgctgagtgttaaacagcttcataatgtttcattgactacatgatattccaacatatatagtttggctgactcttggtatcccatcatataaaggttggctgactccagccctggagtaaaacacttccttttttaaaaaatgaatttggggaccaggtgtggtggctcatgcctgtgatctcagcacctagggaggctgaggcgggcagatcacctgagatcaggagttcaagaccagcctagataacatggtggaaccccgtctctactaaaaatacaaaaattagccggacatggtggtgggtgcctgtaattccagctgcttaggaggctgaggcaggagaattgcttgaacctgggagacagaggttgcagtgagccaagaccatgccatggcacgccaccctgcgcgacaagagcaaaactgtcaaaaaaaaaaaaaaaaagaaaatgagttttaaagtgatggcagtaagcttatttgagaggataaaccctcttccagtgatttagtacttacagagtaggaacatggaaggagtagagatgttggggcatgcaaacagttctatgccaggggtgaatgtataaggtaagttaagattctagctttaaaaacataaaagttaaaaccctgtggctattatcaatcaattacatggcaaacctgttaaggatgttactgtacaagattttgcatggacatatgttttcaattcacttgggtatatacttaggggtataattgatgggtcatatggcaattctttgtttaacactttggagaactgcccaccaattttgcgaaatggagtaccattttacagtcccaccaacagtgtacaaatggttcaatttctctacattgtggttaacacttaaaaaacaaaacaaaacaaaacaaaaaactggggtcaggcacggtggctcacgcctgtaatcccagcactttgggaggctgaggcaggcggataacctgaggtcaggatttcaagaccagcctggccaacacggcgaaatcccatctccattaaaaatacaaaaaattagctgggcctggtggtgggcacctgtaatcccagctacttgggaggctgaggcaggagaatggctcgaacccgggaggcagaggttgcagtgagccgagattgtgccattgcactccagcctgggcaacaagagcgaaactctgtctcaaaaacaaacaaacaaacaaacaaaaaccaaaaaaaaccccaaaactggaatgcttcacagaatttgcatgtcatccttgtgcagggaccacactaatcttctctgtattgtttcagttttagtgtatgtgctgccaacatgagcatagtccttatttttattttagccctcttacagtgggtacttttaaagcatttgatagcaaatgattttttcttccaaggcaaatatgtttaatatgtaagtctagaaaggaaaagcaaaacaaaaatgagctgggcttcaaattcttccagctgtggagtcatttgcaggttgtggagcaggacaagtctgttgcagccaggccaggtgccaattccaacaggcgcatgtgtcatctctggcacaaaaatcacaggtcaccaaaccctgatttgagtttaaaggaagaggcatgaataaggcaactctgggttgtaaagctcaggctgctctttatctccaaaaatttgtcttaaatatgattcttctcaggggtgtttttcccctcttttaagcaaaacaagaagtcaagtacttgtttaccctaaattgcattttttgatctctctcttctgctctctctttccccctcagttgtgtgtccttcccagggagaaaagtggttcagagtacagcctgggggtggagcttggggctgtgccagctcattttcagattaggtatttcgtaacagagttttaggcatgtgcagggtttaggcttctacccaaggaatctattttcacttgcagggaaatttcacactgtaattactatcatgaagcaaaatatggtgtggggtgagggaggagaacattgttactaacccttggatattaacccctacgaagcaagtttggaactgccatacattatcattattaacatttgagtgctctgtgcttgacactgtgtttagagctttcactatgctgttctatttaatcctgataataccctatgacataagcattattgttgttgctattattatcattatcagtgttctcactttaggaaatggaggcacagaaagttcaaataaccagccactatcacacagctttgtaagtagcagaaccagcttagcaggttaggcagtgagtgtcaaagcccacattttcttttttctctttttggactccagggtggagtgtaatcaccttgacttccctggctctagtgagcctcctgcctcagcctcccagtagctgggactaaaggtgcatgccatcatacttggctaatttatgtatgtttgtatgtatttgtttatttttgagaccgtgagccccacgatcttggctcactgcagccttaacctccttggctcaggtgatcctcccacctcagcttcttgagtagctgggaggctacaggcgcatgccaccacacttggctaatttttttttttttttggtataggcagggttttgccatgttgcccaggctggtctcaaactcctgagatcaagtcatctgcccacctggccctcccaaagtgctgggattacaggcagagccactgcgcctggccataatttttctaattttgtagagacaggggtctcaccttgttgcccaggctggtcttgaactcctggaaagtccacactcttaaccattagggtatctggctatatctcacacaatgaaagagggaagaatgtgggagatagcagtagggacagaaactgaggcacgaaaatgacttgagcccaaaaggtccaggctgcagtgagccgtgagcatgccactgcactacagcctgggtagcagagtgaaaccctgtctcaaaaaaaaaaaaaaaaaaaaaaaatcagtcgggcacggtgtctcacttttgtaatcccggcactttcagaggctgaggcgggcggattttaagaccagcctggccaacatggtgaaaccccatttctactaaaaacaaaatttgcctggcgtggtggtgcacgcctgtaatcccaactactcaggaggctgaggcaagagaatcgcttgaacccaggaggcagaggttgcagtgagccgagattgtgccattacactccagcctgggtgacagagtgagattccatctcaaaaaataaaaacaaaggccgggcaaggtggctcatgtctgtaatcccagcactttgggaggccgaggcgggtggatcacaaggtcaggagttcaagaccagcatggccaacatagtgaaaccctgtctctactaaaaatacaaaaaattagctgggcctggtggcaggtgcctgtaatcccaactactcgggaggctgaggcaggagaatcgcttaaatctggggggcagaggttgcagtgagcagagatcgcgccactgcaccccagcctagatgacagtgtgagacttcacctgaaaacaaacaaacaaaaaaaccccaaacaaacctgtgtaccctaaacctaaacgtactaattgatcacattttgccatatttgctcatctgtactctctctccctgtgtgtgtgcattttttctccctaaatcatttgagagcaagttgcaagcaggctagttaccattgttaccggtctggagttcctttcatataaaacatgtgacccaagctagatcaattgaacagattactcttcggaatttgaatcttggaatagggtaatgagaggacaggataaaatgagtggtcttttctagatctactgctggtctcagataagatgttcaagtatggccaggcgcagtggcttacacctgtaatcccagcactttgggaggccaaggcaggtggatcacctgaggtcaggagttcaagaccagcctggccaaagtggtaaaatcctgtctctattaacaaaaattagccaggtgtggtggcacatgcctgtaatcccagctacttgggaggtgaggcaggagaattgcttgaacctgggaggcggaggttgctgtgagccatgattgtgcaattgcactccagcctggaccacaagaacaaaactccatctccaaaaaaaaaaaaaaaggaaaaagaaaaagatgttcaagtatcttcaagtatcttctcttcccttgctttctttttctttatttaaatctttttttctttttttatttattcacttttacttttcttcttttcttccctttgtttctgacatttccgacctggccctccagacttcccattgattctttgagttcctggatatcattttgctacatttcaaagtctattgctgttgcttgcaacccaagaatcctaactggcacagctgcccttgaggaagttcacagggcagcatgtaagtagaggcttcatgcactcagaaatatttgtaggcaggatctcttcatttttggagggcttgttctagttgaccttctaatcgtatcctcagagaatttgtgcctttgggtcccctaggtcaagccaattttattgaggaataatttcagaatttgaaattattcttcctacctattaaaagttctcagccacagttcaacaaaacttcacacttacatagtatttcaataatccattgctgcatagtaaatcactgtaaagattagtggctgaaagaacaacatctttattatctcccatgattctcttggttgattaggtttggtgggatggttcttctgttccagttcttttttttaaaaaattatttaattatgatttagttttttttcttttttttttttttttgagactgagtctcgctctgttgcccaggctggaatgcaatggcgcgatcttggctcactgcaagctctgcctcctgggttcaagcgattctcctgcctcagcctcccgagtagctgggattacaggtgtgtgctaccatacccagctaattttgtatttttagtagagacagggtttcaccatgttggtcaggctggtcgcgaactcctgacctcaaatgatccacctgccttggcctcccaaagtgctgggattacaggcatgagccactgcgcctggccatttatttttatttttaaaaactacctattttccttttttataacttttttttcacaatgttctggtcaacactatagtcacctggggcctctaaggactgaaatgtatgagaaggctcatttgcatggctgacagttactgcaggctcttgcctggaatctcagctggggctgccaagtggagtgcttcagtttttacttcatgtagcctctccatgtggcttaggcttcccataatctggcagctgggttccatgaggaagaaagtgtaagctgccaatcatctttattttattttattttattttattttattttattgagacagaatctcactctgtcgcctgggctggagtgcagtggcacaatcttggctcactgcaacctccgcctcccaggttcaagcgattctccttcctcagcctccagagtagctgggtttacaggcatgtgccacggcgcctggctaatttttgtacttttagtagagacgcggtttcaccatgttggccaggctggtctcgaactcctgacctcaggtgatccacctgcctcagcctcccaaagtgctgggattacaggcatgagccaccccaatcatcttaaagcctagacttgaaagtcccatgacatcacttccactatttccattggtcaaacagttacagagtcaactccagttcaaggaagaggaaataaagcctacctttcgatgtaggagtggcctgtgcaaacagcaggaaagaatgatagtgggcacctacacagactatcttgtagagtgtgtcactcatttggcttagattttgagtctagagcagtgtttccacatgtcactcactacaagatcacctacaggttccatcaaactctgccaatgtttgccaggcgcagtggcacacgcctgtaaatcccagcatgttgagaggccaaggaggttggattacttgaggtcaggaatacaagaccagcttggccaacatggtaacaccccatctctactaaaaatacaaaaattagccaagtgtggtggcacgtgcctgtaatcccagctactcgggaggctgaggcagaggaagcccttgaactcaggaggcggagattgcagtgagctgagatcacaccactacaccccagccggggcaacagagcaaggctctgtctcaaaaaaattcagctgagccagaagtttgaggttacagtgagccatgattgtgccactgcatttcaacatggagaaaccccgtccctactaaaaatgcaaaaaattagctgggcatggtggcatgtgcctgtaatcccagctactcaggaggctgaggcaggagaatcacttgaacccgggagtcggaggttgtggtgagccgagatcacgccattgcactccagtctgggcaacaagagtgaaactccatctaaaaaaaaaaaatttctaaaaaaattcagatggtgtatggtatgaatcattgtgaagacaaagcagggtgatatgactgtgtttgtgcctgtgtgtgtgtttagtgctttagaagttctatccgagaaggagacattgcagcagagacttgaatggcaatagagagcaagccaggaggaaagaaaattctaggcaaaaggaacaacaggtgcacaggtcctgaggcaggaatatgcttggtgtgttcaggaatgttagtgtgacatggggtgagatatagggagagatatatcacctgagatcagggaggggagcagagaccaaatcaattagggtcagagtagtttgttttcttaaatggagtcagggtctccctctgtcacccaggttggagtgcactggcacaattacggctcactgcagcctcgaacttccgggctcaagcaatcctctcacctcagctttctgagtagctaggactagaagcgtgggccaccacacccaactagggtctgagttttatcccaaatgcaatgggatgccattcgaagctgtttaggttggaagttttttgttttgttttgttttgttttgtttttgagatggagttacgctcttgttgccctggctggagtgcagtggcatgatcttggcttactgcaacctctgcctcctgggttcaagagattctcctgcttcagcctcccaagttgctaggactacaggtgtgtgccaccatgcccagctaattttgtatttttagtagagacagggtttcactatattggtcaggctggcctcaaaaccctgacctcaagtgatctgcctgctttgccctcccaaagtgctggaattacaggcgtgagccaccgtacccggcctaggttggaagtaacatgatttaatacatgatttttcaaggatccctctggctactgtattgggagtgccctgtagaggatgaaagggagagaagcaaggagagtagctaggagacaggtgcagttgctgaggtgaaaggccatacacgtgtgagcatttcatctctgggttctcagcatctaacgcagtattttattttattatttttattttatatatatatatatttgaaatggagtctcactctgtcgcccaggctggagtgcagtggtgcaagcatggctcactgcagccttgacctcccctactcaggcaatcctcccacctcagcctcctgagtacttgggaatacaagcaggcgccaccacaccaagctaattttaaaattttttgtagagactgggtatctgctttgttgccaaggctggtcttgaactcctgggctcaagcaatctctcggccttccaaagtgttgggattacaggcctgagccactgtgccctggtggaaatatatatatatatatttttttgagacagagtttcgctcttgtggcccaggctggagtgcagtggcgcgatctcggctcactgcaacctctgcctcccgggttcaagtgattctcctgcctcagcctcccgagtagccaggattataggcgcctgccaccatgcccagctaatcttttgtatttttagtagagacggggtttcgccatgttgggcaggctggtctggaacttctgacctcaggtgatctgcccaccttggcctcccaaagtgttgggattacaggtgtgagccaccgtgcccggcccagaaatgagatatttaattttttaatttttactttttttttttttgagacggagtttcactcttgttgcccaggttggagtgcaatggtgccatctcggctcaccgcaacctctgcccccaggttcaagtgattctcctgcctcagcctcctgagtagctcggattacaggcatgtgctaccatgcccagctaattatgtatttttagtagtgacggggtttctccatattggtcaggctggtcttgaactcccgacctcaggtgatctgcctgccttggcctcccaaagtgctgggattacattcgtgagtcaccgcgcccagccaaaatgagatattttaaataacataagtaaacagaaatatatcatgattttaatgataattcatgctctgaaaataaatgaagaaaggaataggagtagggaaagctgggatcagagtgggcaggaagttaaaatagagcagttagggaaagcctcactgaataagtgacatttggacaatgaccatggggagattagggaatgggttatttgaattttctgggaaaatactgttctaggcagaggaaatagcaagtgcacgatctttaaggccagagtgtgctaagcacgttggagaggccgagtccattgtagctgagttacagaagtgagtggaagagaagaaggtgatgagtttagagagggaagggcagggcaagagacgggctgtatggggctttgcaggttactgcaagaattttgcaggagggacagagactgacttggttcttaccaggattcctctggctgctgtgttgagtatagactctaagaggaaagagtggaagcaggcagaacactgaggaggctgttgcagtggtccaggtgggaaatgatggtgctgaccgtggaggtggtaagtggtcagattattctattttatttacactcaacacatctaatactgactcaatattatctaacatacagtccacattgaaattgccccccaaattctttttacataaaaaaatcatcctgaatccaatcaagtctcacctattgcttttggttttcacctctttcatgctgtcatattttaaaagactccaggctagatgttgtgtagaatgtcccacattctgaattcgtttattttttcaagtaagctttttgtgtgtatgtggcaagaatacgacagaggtagcaatatgctttccccactgcatcatattaggagacacataacaacagtcctgacccattattggtggtgctaagttcgatcacttggtaagggggtgcctgccagatctttccattgtaaagcaagctgttctttattgtaagtcataaatacgctgtgggatgatacttcgggactaaatataccctgaatatactgctgcccaacaacatttcacccagtgactttagcagctaaggaacagcctcgtggcttccgaccttgtgcctcagttcgctcatctgaaaaatgaggatgatcatggtccctaccggatgcttgttttgaggatccgtgcttggcataccagaaacgctccacaaatgttaggtattactggacgaaggcaaatatgaaaaaaattaagggcagggctaggactgcattccggttctccggatcccgagggagctcccagtcgatgctgggcgaaagcggccgcacgagcccacgtcgccacgccctccgccgcggaagccagggtgggggtcgctggaaccctaggccggccgcgcaaggccccctgggaccggtagtgctgggcgtggcctcgggactacatatcccagtggcccccgtgcggcgactttagctgctgctgtctcagccgctccacagcgacggcagcggctgcggcttagtcggtggcggccggcggcggctgcgggctgagcggcgagtttccgatttaaagctgagctgcgaggaaaatggcggcgggaggtgagtggagataaaggaggaggcggtggcgggcgagggggtggagtgcgaggcggagggaagaggggcgagttccccaggctgcgagagccagcggcttcagatctgccaaggcactgaggggcgcgccggccgggggacgcgctgaggtagtttcggggtgtcggggccgcgccgcttcccctcagcccggggggcggcccgcggcggtaggagctgagacgaagctgggtggcagtccgcttggggatccgagggggtccccgcgcggaggggtcacccgaggagtttgcggggggactgcaggggcccactttccccttctgtccctaaagttttttcttcctcttgcctcccccagcccttttgaaagctccccgcgtcgtcctcctgctgccccggctccttagcagcttctgggacgcacgggagggaaaagccgcggggaccccccccaccccagcctcccagccgggtgagatttggttgctgtgtttcctcctcacttgggcatttaaaaaatattttaacacgaattgtccgcggaattttcatgttgggctcgggtagcttcttagttttctcggtaaaaaggcgttttactacctctggtgtgaaggctgggaaatggcaagtgggaagttggttgataaaattaggagtttggctgtctttattactactttttttttttttttgctctccccatctctcattttatgaacatcgacccagttcgtcatggtttaaataaactgcttgtcttgtacctgccttaacaaaactagccatgggtcgttgggagacttagttgcttcctaggcagtttgagggcatctagggtggaaaagttaaccgagagagcgagcatctacctcactggcaggatctgggattcccaaatggaatgacacggaagctatgagattctctcgaagtcgaaacttttttccccctcccgaatgcgaagacttcctttttgcaatatttgagcagggcttcaaaaccaacctgtttttgttattaagcctgtacggtaaagaaacaggaaggagagtaccagctgtcttgctgcagtggttttaaatggagttgaatgagatgcgtgagagtggtagtagtattgagtaagattgctgcatctctttgatttaaatgcctggcctcggatccacctaactgatccctggctgcaaaaaagcttcagtatttgttgcagcaggttgttgagaaggtgattggaggaataaaaatcttaggtcttcagcgaatgctgcacaaacgaaaatgttaatggaaacctgtaagtttgtgaattgtttgttcttgaaaatattttaaatgtatgctcatttagaatatggttctaccgaatgatatccaattggaaaggtacaaacacattgaaaagtgaatctctctttcacgccaaaccctacagtttccccttctcagaggcaaagactgttactggtttttagaatatccttggtctttggaataattattttaagattttcatttgaaaccacttctgttggataccaaaagcagggaaataaaatgaacagaagaaacagaaaatgtgggaatactgtttttgctctcttaaaaaaaatgttgatagctattggaaaaagctcttcagaacttactgcttatgtcaccttatctattaataccgttaaataacaatctgtggggctttaggataaagaactctgccagggttcattgtttgtatgtacaatgaatcctctgcttgtaacatgtaaaatgatattgaacactatagctcctgtcactagaggttgcttcaggttctgcatttcaatgagcagaaatctaaattgcctgtgatcctaaattataggggcattttatgtatagatggaaatgacttaattgtccaatcagcatttgaaataagaggcatataccagcttttggcatatagaagatggggattgtggactaagcgggaggctgtaatatttctagagcagttataggaaatatttctgccataagatatttaattacaaaggctttgaaaatgtacaacttaagcatcaatagcgagatttatatttttatattttagaatggttgttttaacagcttgccaacactaacaatttgctaaggaaattcagtgatattagagctaggttattaaagattatattaaataatttaactgtattttgaaaatgattatgctgtgcatttccttctctgtataaaaattatttctaaaaagtgccacgcacctcccgagcaaataaaatagaattcagtaaggagtgaagtactgttgtacgtgagaccctttttctaggcgatatgcaaataaaaagtagtttaaaaatggttgcttactaatgtcttcttgactggtcttttgaaataagctttcttgcagggacattacattaaagataaaagctaagtgtgtctttttttttttttttttttttttttaacgaattcagttctttctgccgggctgcagtggctcaggcctgtaatcccagcactttgggaagccaaggctggtggatcacgaggtcaggagtttgagaacagcctggcaaagatggtgaaaccccttcactactaaaaatacaaaaaattagccgggcgtggtggcgagcacctgtagttccagctactcaggaggttgaggcagaagaatggcttgaacccgggaggcggaggttgcagtgagccgagattgcaccactgcactccagcctgggcaacagaatgagactctgtttcaaaaaaaaaaaaaattctgtcttgtgcattagcagtatgattctggaataattcattttaacttggagtactgtaattgaaaagtctttaaaagaaaattaaaaaataaattttagtttggacaatagggtaagatttaaaaactctgctattgtcctatcccaaattgatggttaaaataaatggctttgggtttttggttttttttttttttttttttttttttgcgggcaggggcgttttttttttttcttttctttctttttttttttttttgagaaggaaatttgctctgttgcccaggctggagtgcagcggcgcgatcttggctcactgcaacctctgcctcctgggttcaagcaattctcctgtgtcagcctcccaagtagctgggattacaggtgcgcaccaccacgcccggctatttttgtatttttagtagagacaaagtttaccatgttggccaggctggtctcgaactcccaacctcaggtaatccacctgccttggcctcccaaagtgctgggattacaggtgtgagccatcacgccagcctgcattttttaaaaactatataatttcacactttggccagaggaggtagagtacttttgaaaacttttaatttgttgcaagtttagaatgcatattagccgccagtgacttttggtctacaacagcaaatttgtcacaatttaatacagttgttaccctgtaaagctatctaggattagaaaaaaaacaagacttgttgatcatgattgaagagattacctgtagcagtttggttcatatccttggtataaatatttgttttttgcattactgagcggttaaagctctgagagcagaaaattagtattggaaatgtatgttaactttttcttatttttttctcatacttcaaaaaattgaaaaacaaggggactatattggtttggattctcaggaatagctttgagattgagtgctgcagtaaaatgtaggcattttctcctttttttttttttttttttgagacagagtctcactctgttgctcaggctggagtgcagtggcatgatctcggctcactgcaacctctgcctcccaggttcaagcgattctcgtgcttcagcccctgcccgagtagctgggactaccggcgctcgccaccatgcccggctaatttttgtatttttagtagagatggggtttcatcgtgttggccaggctggtctcgaactcctgacctcaagtgatcctcctgctttggccttccaaagtgctggggttacaggcgtgagccaccgctcccggcccattttctcccattttatgagtgcttcttggggttggggaggggttacaaaataaacacttcagaattaaggtggaggaggggctttgtggtaatgaggcatattccatgagtttggtcatgtttttactaggtaaattcattttgtctatcatttttctgagagggtttctgggagaagattattttaggttaaagatgcaatttatccagagcctaactttattttcagccccctaacaaattatggaattgaatttaattgcctttccctttcctaccttctggtggagagtttttaaatgaacaggaaaatggccagaaaatacacagcaggagtaggatgggagacctgcagtgtgtagaaggccgatttatccacaaactggataatcttcttaggctgcatactgccagtaccaaactttgttagcattaactcagtttggtaggtactgccagcctaggtcagtttacagtggggggcagtaatagggtttatttaactaactgtgtagtaaactttgtggcctaaaggcaaaggaaaggagtcggacctgactggcaaacaggttttacccatttaaagtaatattccaagagcaaatggactagtgtctattttgtttggcttttaaaatatttttgttaggaacatctgtgtctttttttttaaattttctgttaatttttttattgatatgttctaggaaagggtgtgacatttttcatctgttattcctatgaaaaggtattctgttgaaatgtttaatttccttggttagaggctatgaatgagggttatgcagcttcactttttggaaaccagggtgactagattactgaatttaactattgattagccacataatgatgaaaagggaatcttggcctgggtatcacacagtaatggataatctgcttcctggggctttgctttggtggctatggcagctgagttggcgtggtagatggatagatgggaaaggactgcagaagtcagcataatcctcaattaggataagccttatggttaattgaatgttgagtgtacaggttaaatcccattataacgaactccaggggactggccaaattattttgttgtactgggattagactttattaaatattgtttaaaacagtctttttgttagaggtgttagagattttggaaaaatttccatttattgtaacaatttgacaagttgttcatgaaccttccatctttaatgcttttacctttaaaaagaaaagaaagcatgttgagctgggcagtggcagagcatgtatatcacccctccacaccatgttttgagtagctcttggtttatgtcgacaacctaattagtttgttagtaagtactaccaccatctaagtgtggtcagaagaatgggaaattccccaggtttgcaggtgactggtgctgttaattttttctgtccccaacaacatgtatatatatttttaaatttaaccctgatccttagagcacccaacaactttttgttgttgttgttgttgttgttttgagatggagtttcactcttgttgcccaggctggagtgcaatggcacgatcttggctcactgtaacctttgcctcccaggttcaagtgattctcctgcctcagcctcgtgagtagctaggattacaggcatgtgccactacacctggctaattttgtatttttagtagagatggcggtttctccatgtgggtcaggctggtctcgaattcccagcctcaggtgatctgcccgcgtcggcctcccaaagtgctggaattacaggtgtgagccaccacgcctggccaacaacttttaaaaaataaatgaatatacatcattttagtgtgaaatttaagtcagtaataattgacttagcccctttctcctcagctatcaatgtaggttgagatttttaggtctataaattgtattgtttaaaaaaaagggatagtaatgatgtagtttttaacttcgtgatactatccatataaatatgaaaattttcagaaacaagcttaatttatatacatataagaaaaagactgttcttatgcttggccagaaatatacttctttctgtcctgtacttttattaggttggtgtttgccaagcttcaggcatttacatcccaccttcatatctaaggctagcatttttagtttgtttagagaatttggattgggtgcagcaagacatttttgaagtcattcttttaaatagatgttccatgaaggagggaaaatctgaaagaaggaatttcaaagcaacccaagcagtgttttgaaaattctcaagactgaagaataatgactgactagtaggcaggaagcctgcagttgtattgtggtattgttcctccatctcatgcatttgagaactttagtacaaaagaagagaaagcatggggaggggaagaaagggttttaacaaaaaagggggcacttttggagtaaatattctttgcccttctgtttaaatgaaatctaaagccatattattttactttgaaagaaaatgtgtatcataatagaaatgtcctaaactgacatttttataaatgaaagttaattgctgttggtggaaagagcagcatgatcatatgttcagtttcaaaacagaactttgattaaaaagaaatctacatgtgaaaacctttttttcctttttggtacctgatcaatatattttgttagcttgttactttgaaaagaagacttacctagggcagagttcagaataatttgtaagcatgtgctataagctttggacaaatcaatctctcttggccagtttttaaaattttaaaacaaagggtgctctgtatggttttccaaggttccttattttatacaattctataaacttaaggcattatgtagatatgtacaatgctcttttacttaaattttgttgattgaacataaatgaattaagctctttataccagataaccgtgtgaagttagatgcagctttcagtgctgacttataaagaatttagaggctgggtcccatggctcacacctgtaatcccagcactttgagaggaggatcacttgagcccaggaatttgagaccagcctgggcaacaaagtaagatcctgtctctataaaaaataggaaaaaaaaattagccgggcatggtgatgtgcgcctgtggtcccagccgcatgtgagactgagctgggaggatgacttgagcccaggaggttgagggtgcaatgagctgtgattgtgccattgcacaccagcctgagtgacagagtgagaccctgtctcaaaagggactttaatcgcctgacttcatcacagtatatgctataactgggtaaaagtgtgtgtgtgtgagagagagggattttcagtcccctccttctcgtgtaagaaaagcaagtgttactttctttactctcagtgaaattgctgtcgttgaaatggattatttaagtcatcttgtggagtagctatatcagcttgagtttgtttccagattgaaatttggcaattttggggctgagtgcagtggctcctgcctgtaatcccagcaatttgggaggctgagaccagagacttgcttgagcctaggagttcaagaccagcctgggcaacatagcaagacccccccatctctattaaaaaaatttggcaattttatttgaaaatgttataagagttactcagtactgtttatcaaattgtccctttagtctactacacactctgtgttccatcccagctcatctatttccttttacttgcttggtggtaattgtgttttatgacaatgtgttaatctcaattgaggtagttgtcttcaccgcagttggaacagtagttgactacatataggaaaatctaccagtgaagaaactccaccagtgagaaaaataactctacacatcttgcatcattggagggtcagtgatatctttgtcatataataagacaggactgttaccatattaagtttaaaactactttcatcaggaatcaataaaatggaatccagaaagcgactttaaacgtacacagtcatggccaggagtggtggttcacgcctgtaatcccagcactttgggaggccaagatgagtggatcacgaagtcaggaattggagaccatcctggccaagatggtgaaactccgtctctactaaaaatataaaaaaattagctgggcatggtggcgggtgcctgtaatcccagctactcaggaggctgaggcaggagaatcgtttgaaccctggaggtagaggttgccgtgagctgagatcgcgccactgcactccagcctgggtgacagagcaagactccatctcaaaaaaaaaaaaaaagtacacgatcatatctagaatggtagaagccttgagtgtatgggttctaagatttggcaaacctgtaagcatgaacttgcccagtaaccttcagtttcccttttctttcccccaaatcacaatatagtcatccacatgggacttttaaaaattaattcaatttttggagagggtcttgctctgtcatctaggatggagtgtagtgtcaccatcacagttcactgcagccttgacctactgggctcaagcggtcctcccagcgcagcctcccagtagctgtgactacaggcacatgtcaccactcctggctgatgtttttaagttttgtatagaaggtgtgtctttggctggtcttgaactcttgggatcaagcgatccttctgccttggtctcccaaagtgctgggattacagatgtgagccatcgtgcccagtatagtgagttttcttaaacttagttttcataccactcttctaagtcttgaggccttaaacttcaatcatctttaatttgctgctgcttggttgttgttgcctactcttccatgcacagacatacttaatcagtgattattatgcctttactatttaaggaactgtgagagttaacaaagtttgtgacctccaagtgtgcacaatcaatcaggtactcatatcacttcagtacaaggcaatcagtgataagtcggttttgcctatagagattgtagagaagttcagaggaggcaagggactactactgatccaggccatcagggtacagcatgttgaagaataagatttaaacattttctttctttctttctttttttttttttgagatgggggtctcactgtgttgcccaggccagagtgcagtggcatgatcatggttcactgcagccttgaccaccagggctcaagcggttttcctgcctctgcctcccaagtagctgggactacacgtgtccaccaccatgcctaattttttttttttttttttttttgagacagagtctctctttgtcacccaggctggagtgcagtggcgtgttcttggctatatagatatatagctgagatatgtatctctctcgagatatatatatatatatatatatatatatatatttctttttttttttgagacggtcttgctctgtcacccaggctagaatgcactggtgctatctcagatcaccgcaacctccacctccccggttcaagtgaatctcctgcctcagccacccgagtagctggggttacaggcagcactaccacgtggacccagctaatttttgtatttttagtagagacggggtttcaccttgttggccaggctgatcttgaactcctggcatcatgatctgcccgtctccaaaataaaataagtgggaactatgctacacatggacatattgtgtggaataatagacaagagactaggaagggtgaggagggggatgatgagagattacttaatgggtacaatgtatgtgatttgagtaaatgatgccctaaaagtcctggcttcaccactaggcaatctatgcatgtaacaaaattacacttgtaccccataaatttatacaaattaaaaaaaatcaggctgggtgcaggggctcatgcccataatatcaatactttgagaggctgaggcaggaggactgcttaaagccggaagttaaagactaggctgggcaatatagtgagaccccatcctatgaaaaaaaaataggaaataataaaataatttttacaaaaaacaaaatataaacacaaaaaaagtttttcttctagaaaaaataactaatttacatctcaataagataaaaacaatccaacttaaaaataggcaaaagagactggaccccgtagctcacacctataatcccagcactttgggaggctgaggcgggcggatcgtgaggtcaagagatcgagaccatcctggccaacatggtgagacaccgtctctactgaaaataaaaaattagccgggcatggtggcacatgcctgtagtcccagctactcgggaggttgaggcaggagaattgcttgaacccggcaggcgaaggttgcagtgtgccgacatagcgccactgcactcgaacgtggcaacagagtgagactctgtctcactaaaaaaaaaaaaaaaaaaaacacaaaagatatatacagagacttcacagaaaaaaggtacaccagtggcaagtaagtacgaaaaaagatgctcaacatcagccattagggaaactgaaaactacaatgagataccactatacactcactatgaggggtaacattaaaaagactgaccataccgtttgttggtaaggatgtggaacaactagaactgtatcatacgtggatacatggctaggagaaatgtgaaatggtacaatcactttgagaaacagtgggcagtttctttaaatttgtaaatattggctgggtgcagtggctcaagcctgtaatcccagcactttggaaggctgaggtgggggatcacttgagatcaggagtttgagaccagcctggccaacatggcaaaacctggtctctactaaaaatacaaaaaattagccagatgtgatggtgtgtgcctgtaaccccagcttctcaggaggctgaggcatgagaatagctgaggcatgagaagagcccagaaggcagaggttgcagtgagccgagatcccaccactgcactccagctggggaaacagagcaagactctgtctcaaaaaaattaaaaaaaataaaataaacttgtaaatattatacacttagcatataacccagccattctacttctgggttccccccaagagaaacacaagcttaggtccacacactaccctatacacaaatacgcagagaagctgcttacttaccatcaaatacatatgaggatatttacttccagttttgtttgaaataatatgaaactgaataaatcatgatataaccatacaatggaatgcagtgtaattattagaaatttctaagcaactattagccgggcgaggcggctcaagcctgtaacctcagcactttgggaggctgaggcaagcagatcattcaaggccaggagtttgagaccagcctggccaacatggcaaaatgcggtttctactaaaaatacaaaaattagctgggcgtggtgacacacacctataatcccagctactcaggaggctgaaacatgagactcacttgaatccaggaggcaaaggttgcagtgagccaagatcgcgccactacactccagcccgatggagcaagactctgtctcaaaaaaaaaaaaaaaaaaaaaaaaaattataagcaactgtaaatcaaactgatatgaatccttccccaagatcatttttaaagtatgtacagtgcaaagcagggctcttgagtgccagttacttaggtgtgttcattttataacaatttagcaagctgtacttgtgcccttccataaatatattatacatcaatttaaagtttgccaaaaatataggcgaaatgcttaaacttaaaaactttaaactatatgcatgtatatgtacctagactagggtaacaatggttccagggcagggaaggaggcagctaagaaaggacggccactgtataccctctgataacttttaaattgatctgatgtgtacctgtaatttatttcaaaaagtattttcttaactgagaccatttgcaactctctttaagtcaacattttcttttttttttctagtatcagaagattttatttttttacttttatttttttgaattttttttttaatttatcaacattttcttaatatagaaataaagtagaggcagagatggatttaggtccataacagttcttcataacccaatttcaaattttctacatatcacaacagtctcattctcactacttttataactgaaaaaacagtataaatttcaaaaataaacttgtaacaaatctttttttattttttttgagacggtctctgttgcccaggctgcagtgcagtggtacaatcttgactcactgaaatctccacctcccaggttcaagcgattctcatgtctcagcctctggagtagctgggtgtataggcatgtgccatcattcccacctaattttttttttgtatttttggtagagattgggtttcaccatgttggcctggctggtctcaaattcctgccctcaagtgatctggcccacctcggcctcccaaagtgctgggatcacaggtgtgctgtttttttgtttgtttgttttgttttgttttttgctttttttttttttttttttttgagacagagtcttgctctgtcacccaggctaaagagcagtggtgcaatctcagctcactgcaacctccgcctccagagtagctgggattacaggtgcctgccactatgcctggctaatttttgtatttttagcagagacagagttttgccatgttggccaggctggtcttgaactcgtgactttaggtgatgcacttgcctcagcctcccaaagtgctgggattacaggcatgagccaccacacccagcctcttgtattttaaatagtgttttgtataagatttcatttgtgttaaaaaaaaaaaattctacagcaaaagaggtttgaaaaaccgggactatgaatgatataatgtatattaagcatttaacactgcccagggacagacacacaaatagtaacttttaatagctatatatatatatttaaaaaaaatttttttttttgagatggagtctcgctctgttgcccacctggagtgcagtggcacgatctccgctcaccacaacctccgcctcctgagttcaaacaattctcctgcctcagcctccccagtagctgggactacaggcgcgcaccaccatgcctggttaattttggtatttttagtagagatggggtttcactgtcttagtcttgaactcctgatgtcgtgatccacccccctcggcctcccaaagtccaaagtgctggaaatacaggcatgagccaccacacccgagctttttctttctttcttttttttttttttttttcttttttttaagacaggtcactgggtcactctgttacccaggctggggtacagtggcatgatctcggctcactgcagtctgccttctgggtttaagcgattcttatgcctcagcgtactgagtagctgggactagaggcatgcaccaccactcccagctaattttttattttttagtagagacgggatttcactatgttggctggtcttgaacttctggcctcaagtggtccgcccacctcagcttcccaatgtgttaggattacaggcgtgagccactgccctcagccttaataccaatattatcatcaatcaataagtggtagcttttctgtggtatatccagacaatggcatattattcagtactaaaaagaaatgtgctatcaattcatgaagagatgtgaagaaaactttaagttttcacttagtgaaagaagccaatttggaaaggccacatactgtgtgattctaactatgtgacatcttagaaaaggcaaaattttggaaacactagaaagatcagtggttgccaggagttagtggggaggaaagaatgagtagacagagcacagtactcagggtagtgaaactactctgtatgatagatactataatggtagatacatgttgttataaattgttccaaactcataaaatgcacgataccaggagtaaactctaatgtgaactacacactctggatgataatgatgcctcagtgtaggtacaaatgtatcaagatggtggggggatggtgataggggaggctacacatgggtttgggcaggaggtatatggcaaatctctgtatcttctgttcaatattgctgtgaacctaaaacgcctctaacaaaataaagtgttaaaaaataaatggcagcttttatcttttctacccaggaataggaactgaaatatagatcaggacacagggaagagaattttattggaataagagggtagaagacagagcaagggtctagactatcaagcaactgacatataaataagatacacacatagaattagaaagatggtggttgaaatgaaaattaatagtcagattatgaaaatctttgggagctccatgtgaagtttagtttcgaattttagacaataaaaaacaaaggttccaagcagtcaagcaggctgggtgcagtggctcaagcctgtaatcccagcactttgggaggccgaggcaggcatatcatttgaggtcaggagttcaagactagcctggccaacatggtaaaaccctgtctctacaaaaaagtacaaaaataaaattagccaggcatagtggcacacacctgtagtccaagctgctcgggaggctgaggtgggaaaattgcttgaactgaggaggcagagattgagccaagatcacgccactgccctctagcctgggcaagagtgagaccctgtcttaaaaaaaaaaaaaaaaaaatttgctgggtgcagtgactcacatctataatcccagcactttgagaggcctagacggatgaatcacttgaagttaggagtttgagaccagccagcatggtgaaacctcatctctactaaaaatacaaaaattagccagtcgtggtggcacatgccagtaatcccagctactcgggaggctgaggcaggagaattgcttgaaccttggaggtggaggttgccatgagctgagatagcaccactgcactccagcctgggtgacagcgagactccgtctcctccccaaaaaaattaccttataatattttttactataacgaaacagtacagagtaaaaagagatgagaaagagaagaaactgaagcagcagttaattccctttagatctattccatcttcttcaagtattcgctaataatcccagttgaaaaggacttttcttcctctgaacttgtgaaccacctgcttatgttgatgcaattacattttcttctttttttcttttttctttttctttttttttttttttttgagaaggagtcttgctctgtcgcccaggctggagtgcagtggtacgatcttggctcactacaacctctgccttccgggttcaagtgattctcctgcctcagcctccctagtagctgggattacaggtgctcgctactacacctggctaatttttgtatttttagtagagacgggtttttgccatgttggccaggctgttctcgaactcctaacctcaggtgatctgcctgcctcggcctcccaaagtgctgagattacaggcgtgagccaccacgcctggccaattacatttatttttcaactagattataaactcctagatcacaaagggattctaacagtcacattacttagcacaattctttgaaaaacagtggtactgaataaaaacatttaaatgatgtaaagaaggatcgtccagtcctagggcaatttagaaaacatggaatgtactctaaggctgatatgattttcctgggacaactctgtgagggagacacaggtcccaagcaaatccctaggaatatttaattttaactccatttccaggtagaaaaactgactcgagggttgaattctaaaaactttcacatccaggccagccatgatggctcacacctgtaatcctaatactctgggaggtcgaggtgggagaattgcttgagtccaggagttcattacaagtctgggcaacatagggagaccccgtctctgccaaaaaaaaaaaattagctgggcatggtggtgcgcacctgtaatcccagccactcaggagactgaggtgggaggatcgcttaagtccaggagttccaggctgcaatgagccatgatttcaccactgtactccagcctgagaaacagagggagaccctgcctcaaaataaataaattaaattgggggaaaaaaaaagaaacataattgaaaaaaataatagaggattttctttttctgttttttttttttttttgagacagagtttcgctcttgttgcctgcccaggctgcagtgcaatggcatgatctcggctcactgcaacctccacctcccgggttttcaagagattctcctgcctcagcctcccgagtagctgggattacaggcatgcaccactaagcctggctacttttgtatttttagtagagatggggtttcaccatgttggtcaggctcgtctcgaactcctgacctcaggtgatctacctgcctcggcctcccaaaatgctgggattacaggggtgagccaccatgcctggccaatagaggatttttaaagcttataaaaggattactccttaccttcaagaaatagacaatttgaatccacgctaccaatcaagaagtactgactcacatgcacacgaacaattaagattcatctaagaaatgactggtgcggtggctcacgcctgtaactccagcactttgtgaggccgaggtgggtggatcacttgaggtcaggagtttgcaaccaacctggccaacatggtgaaacctcatctctactaaaaatacaaaaattaggtgggcgtggtgacgggcacctgtaatcccagctactcaggaggccgaggcaggagaatcgcttgaacctgggaagtggaggttgcagtgagccgagattgtgccactgcactccacactgggtgacagagcgagactccatctcaaaaaaaaaaaagaaaaagccaggcacggtgggtcacgcctgtaatctcagcactttgggaggccgaggcgggtggatcacttgaggtcagaagatcaagaccaccctggctaacatggtgaaatgctgtctctactaaaaatatgaaaagccaggcgtggtggcgtgtgcctgtagtcccagttactcaggaggctgaggccggagaattgcttgaacctgggaggccgagactacagtgagtcaagactgcaccattgtactccagcctgggtgacagagcgagactccatctcaaaaaaaaaaaatgatatttttagttttggtgttctggtaatttacctacattagatggtacctgagatgggcccaacaactagactagaaagcagtggagaaacaagggagaagatggagaaaaaacagtatgtctgaaaccaagggaaattagtctgaaagactgataaaaagacggtgattaagaactgaatatcaggttaagaaatttggagccaggcatggtggcacacacctgtaattctagcactttgtgaggcccacttgggaggattgcctgagaccaggagttcaagaccagcttgggcaatgtggcaaaactcttgtctccacagaaaatttttttttttgagagagtctcgctgtgttgctcaagctggagtgcaatggcacaatctcgctcactgcaacctctgcctcccaggttcaagagattctcctgcctcagcctcccaagtagctgggactatatagatgcccaccaccacgcctggctaatatttgtatttttagtagaaccggggtttcaccatgttggtcaggctggtctcgaactcctgaccttgtgatccgccggcttcagcctcccaatgtgctgggattacaggtgtgagcaactgtgcctggccaaaaaaaaaaaaaaaaaaaaaaaaaaaaaggaaggctacaggttgtcagtggcctcagtgctttcgggctacacccttgtttacagtgacaacaaggtggtattggagtgttacagggtcacagagaagaccttcaattatcaattagaggttttaaatttaaatttaccctggcttttaaaggaacagggtacactgttttctctttactgcttctctctctgactctgtctctctctttctctctttgactccctctttgtctctctgcctctctctctttcctctgctggtctttccctgcctctgccagccacttatgccgctgttctcccctctccttgcccttcccctaggggaggaaccggcaggagtggagctactctttcttcccctgagaagaaaggaaaggggagttctgaatattttccttactaccggaggtttgtgtgaggttcaaccccctgaaatttgcggaaggctcaacccctcaaaccagtggtgtcttgtcttggctttcctggaagactcaacctctcaaaccagggatgtcttgccttgcctgccctggaaggctcaaaccctcaaattagggatgtcttgtcttgccttgcctgccctggaaggctcaaaccctcaaactagggagtgtcttgccttgctgccctggaaggctgacctgtttcctccctttccccctctgaaggtcctttgcgctcactgaacttgtgttgtcctctctggctgctcccctgagggagaattaggcccctcttagcgttggtgtgctggtataaatcccacggcaggatctgccctaagccatatgaggtagctatggaacgcagagggcacccactcactctgtccagcagtaggacttgtcatcatctacacgaacaacaccgcaagtacggttgtttgtgatcattcacgcacatacacatttagcccttcagaatttgaccaccaaggaagtactctaccggctcccacggcttctccttccttggtgtgtgcacagagtcgtcgccgcagtatgtgaagatcttttacctaggttgctggccagtttctttccgccttgctgagagctcagcttattcgtcgcactgcgtgggtcctgatttgtcacccctgaggccgccacaagggggcggggtgcacctcctcacaagagagaaccagagaccgcccccggaggggaatgtaatcacaggcaagcccccaaatttgtataaagtttcggtgccacaaaagaaatagcactcgaatataagattttctttttttttttctcagcaaggcaatttactcttatagaaggatgcaccttcacagatggagcaatggtgagcgcacacctggacaagggaggagaaggggttcttattcctgacgcacgtggcctctgctgctgtgtcgttcccctattggctagggttagactgcacaggctaagctaattccgattggctaatttaaagaaagtgttggggtgagtggtttggcgggaaaaatggctgtggcagagcaggaaacaggaatgagtcaagatgaacaatgagtcagggtggagcaggtaatcagaataagtcagagtggaacaggtaatcaaaaaaggttgctctacagggaagttaagtttaaaagtagaaggcaaagaattgaacatactgacatattctttgaagagaaatttagaactcatatccaacactcaggcaccataccatatagattatggaggtcttgaaatcagatagagtaattcttctaactttattccttttcaagttgttttggctattctaggccctttgcatttccatataattgctagaatcagcttatttctgtgaaatttctgttgagattttgattgtgattgcattgaatcggttgatcaatttggagagaatcaacatcttaacagtattgtgcctttgcttccatgaacacattgtatatcttttcatttatttaggtcttatttagtttccgttagcagtgttttgtagttaccattgtacagatctttttttttttttttttttttttgagacggagtcttgctgtctcctaggctggagtgcagtggagcgatctcggttcactgcaagctccgcctcactggttcacgccattctcctgcctcagcctccggagtagccgggactacaggtgcccgccaccacgcccggctaattttttgtatttttagtagagacggggtttcaccatgttagccaggatggtctcgatctcctgacctcgtgatctgcccgcgtcggcaaagtgctgggagtgctgggattacaggcgtgagccacagcgcccggcccttttttttttttttttttgtggttttaaggagagagtttaataggcagaaagaaagggagaagacggaagaagctcccccatacagagacagaaggaggggggctccaaaaccaaaagaggaagtccccacctgccacagataccagccaggtatatatgcagcggctggaggaggcagtgtttgatttgcatagggctcgggattggtttgactcaacaaatcattcgcgtagcccgtgaaaaagctgaccctcccaccctggccttttaatatgcaaatgcaggggcgctatgatgttctacacacgtggggatatgtgggggaggccatgttgccaggaacttgtggggaaagggcaagaaggctgaggcaatctccatgtttgggtggacccattttctaatggcctgcatttgcatatcaaaggttgttggcctggctctaagagctgaggctttacgagaaacttttccagagatgctttaaaaaaaaaaaaaacgagcccggcgcggtggctcacccctgtaatgccagcactttgggaggccgaggtgggcggatcacgaggtcaggagatcgagaccatcctggctaacacagtgaaaccccgtctctactaaaaatacaaaaagccaggcgtggtggcctacacctgtagtcccagctactccggaggctgaggcaggagaatggcataaacccgggaggcggagcttgcagtgagccgagatcgcgccactgcactccaggctgggcgatagagcgagcctccgtctcaaaacaaaacaaaaaaccacgaaaacttcccaaggaccccttttcctataacattatcccctgtggagatgccacactaactgttagggggttttgggcgatgactctttctggctacttcctgctgaaaaggggcgtggaatgggaaacagcagctagggctccttctggggttgatccaagggtcttcggaggaatggctggcctgtccatgtgtggttcagtttatggcaccatttggagtttgattgcttctaggcgagaagaaatatttcgagtgatagtattaactatacggggtccaaatattagtacaagacgtataagcaagagagtgcttagtaaaggggttaaccaattccataaagaagactggaatttattaaagaggggttgtagccacttggagctgaatctggcattttccctgagcctgtcaataattttgatttttaagtacctgtagattttcctctactttactagaggtgttaatcccaaagcagcatgtttcgtttaaaactgctttactaaacccaataaaaagtcctagcggactcagcgatagtgaaactttcatgcttcctttttgtcaactattatccctgctataaggataataattaagcaaaatattacagcagtggaaactctctaatatttcagttagaaggtgctaccatgtataaccctattgcaaatagtagagtgaggacagcaattcccacaagtgtggtattttcatagcccatgctaaagcatttacccatagaagaacggttccggttaacttctgaacttaaaatcgccttactaattaagtaccatcttaataggagccagaatagatggcttaaaggaatgtaggaaccgaatggtcattttcctgtcagtgggacaatattgagacaaaaatttgtctacggaagacattttactcctgttaaaagcagaaacttcctgttcccagaagaggcctacagcctgatttctactaggtggcttaggaataccatgtgtttgccagaatgtagagagagagagacatttattgaattactgcctgccgtgattcacaatcttttctaacatacctgtttccctgaactgtaaagactcctgcatgttagacacacggagagagggtaagagaccgaggatagaaagagaaagaaagtttggcgacagggtagctggaagagagccttgaaattaaaggacagatttaaagttgaaatccattccatacccaccactctgatggttgaatttcctttcctggcccatgcaccaaaatgatacggctctaatgagtgggggaacaccagggttcttggtcctcatgccagtttagataaaatgacttgggcacacgtggagtggttttaaggagcagaaggtttaatagataagaagtgaagggacaagtgaagggagaagacagaaagaggaagctccctggtacagagacagagggagggggctccaaagccaaaagaggaggtccccccagtatacagatcttataaagcttctgtcagatttatcagtaagttccatatatatatattttttgagatggagtcttgctctgttgcccaggctggagtgcagtggcacaatctcggctccctgcaacctctgcctcattctcctgctgcagcctccccagtagctgggattacaggcatgtactaccatgtccagctaatttttgtatttctattttattttatttatttatttatttttttcttttttctttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggacacagcacatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccaataggggcggccgggcagaggcgcccctcacctcctggacggggcggctggccggacggggggctgaccccccccacctccctcctggacggggcggctggccgggcggggggctgacccccccacctccctcccggacggggcggctggccggacgggggggctgaccccccccacctccctcccggacggggcggctggccgggcggggggctgacccccccacctccatcccggagggggcggctggccgggcggggggctgaccccccccacctccctcccagacggggcggctggccgggcagaggggctcctcacttcccagtaggggcggccgggcagaggtgcccctcacttcccggatggggcggctggccgggcggggggctgacccccccacctccctcccggatggggcggctggccgggcggggggctgacccccccacctccctcccggacaaggtggctgctgggcggagacgctcctcacttcccagacggggtggctgctgggcggaggggctcctcacttctcagacggggcggttgccaggcagagggtctcctcacttctcagacggggtggccgggcagagacgctcctcacatcccggacggggcggcagggcagaggtgctccccacatctcagacgatgggcggccgggcagagacgctcctcacttcccagatgtgatggcggccgggaagaggcgctcctcacttcctagatggcatggtggccgggcagagacgctcctcactttccagactgggcagccaggcagaggggctcctcacatcccagacgatgggcggccaggcggagatgctcctcacttcccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatccctgcacctcgggaggccgaggctggcggatcacttgtggttaggagctggagactagcccggccaacacagcgaaaccccgtctccaccaaaaaaatacgaaaaccagtcaggcgtggtggcacacgcctgcaatcgcaggcacttggcaagctgaggcaggagaatcaggcagggaggttgcagtaagccgagatggcagcagtaccgtccagcttcggctcggcatcagagggagaccgtggaaagagagggagagggagaccatggggagagaggggagaggggaggggagagggagaatttttgtatttttagtagagatagggctttaccatgttggctaggctggtcttgaactcctgacctcaggtgatccacctgcctcggcctcccaaagtgctgggattacaggcatgaaccaccacatccagccagttccatattttttaatgagattataaatagtattggattttagatttcaatttgaataatttattcttagtatatagcaatacagttgatttttgtatttttgcctaatatattataactttgctaaattaattttagtagcttttatgtagtttgcttaggattgtatatataggtgatcatgtctgtgaataaagacagtttaattccttcccttccagtcagcataccttttttttcttgctctattgttatggcgagtacttctagtacattgttgagtagacatctttgttttgttctcagtgttcggggtgaatattaagatgttatgggtctgctgatctgctttgtattagtatagtattgtttctagaatttcatataaatcccatgtaatcataaagtatgttgtgtcagcttcttttttttctttacgtatattttgttgctgttgttgtgtcatacttcttttgcttagtctaattccctgagattcattcatgttgttgcatatatgagttcttattttgtttctgagtatgtatatagtatatagacaatacatatgggcagtttgtttatttaccagttgagcaacatttcttagctattatgaatagagccgctgtgaacatttgaatacaaaccttagcgtgggcagaaggtttcattttcttggacaaatatctaggaggtggaattgctggatcatatggtaaatgtatgtttaactttataaggaactgtaaaactgtttacctgtctgttccattttgtgttctcaccagcagtatagccaaatttcagttttgtaacctcaccaacacttggtattaatattctcctatgttttagccattctggtagatatgtagtggtatcccattgtgattttaatttgaaatgtcattcagcttctttggtgaagtgtctgttcaaatcttttgcctccttttcctttcctttttcttttctcctcccccttctgttttgaaaatcaggttgcttttctgttactgaattcttagaaaaaactgagttcttaggaaaaaaactcatttttttaaatgttctcgatatccatcttttattagatatggtttgcagatattttctcccaggctttgttggtacaattctaattgatcagctgagtctctgtagtaatgctccatttcttggtcatatgtatattttgaggaataacaagtgttttaaagctcaaaataacagttatgctaacatatactataagctgcattctttaatccatatatagggaaagaaaaacctagattgttaatccggaacatttacattcttaaacatagtaaattgtctactgtacttaactatgttaaatacttttaaatggcctagagcttcatctttttatctaataaaaatgaataaataattccttgtctgtttcattatttattattactaactaaaatgaaaaactatgaatatattggtctggtataaacctaatgaaaagttgccaaaataaaaaaacacttaatcttgcctataagcttttgccattgttccctctctaaccctcactgaaaaacccaatctttatggcttacctctattagtatacaatatattacttttgcatcaagtatatacacatactgtcttgtctttttgttctttctatgcgtaactgttctactgacttgaattaggttttgaatgcttgctgtgtaagctgatgagaaaaaaaaatcagctttacaatgtgatatttgtcacatttagcaattatattaaattattgtaacactatattacctaagtatctacctggacacttttttttctttttctttttgaaacggagtttcgcttttgttgcccaggctgaagtgcaatggtgtgatcttagctcactgcaacctccgcttcctgggttcaagcaattcttgtgcctcagcctcccaagtagctggaattacagccaccacgtccagctaattttgtatttttagtagagaagggggtttctccacgttggtcaggctggtctcgaactcccgacctcgggtgatccacccgccttggcctcccagagtgctgggattacaggcgtgagccactgtgcctggctggacacttttttttcttactcagggtgatactcaactcaatttatttatttatttaaaaaaattttttttctttttttttttttgagatggagtttcactctagtcccccaggctggagtgcatctcagcactgcaacctctaccttttgggttcaagcgattctcctgcttcagcctcccaagtagctgggattgcaggcaccaccatgcccagctaatttttgtatttttagtagagatgaggtttcaccatgttggccaggctggtctctaactcctgatctcaggtgatccacccaccttggcctcccaacgtgctaggattacaggcatgagccgccgtgcccagcatctaaaaaacttttttgagacagagtctttgtcgcccaggctggagtgcagtggtgtgatcttggctcactgcagcctccatctcctgggttcaagtgattcttgcgcctcagcctcccgagtagctgggaccacaagcgcatgccaccacacctggctaatttttgtatttttagtagaggtggagttttgccatgttggctgggctggtctcgaactctgacctcaagtgatccaccggctcaacctctcaaagtgttgtgattacaggcgtgagccactgctcctggccttacctcaatttatttaacagtcccctcacccaaatgtgaagatgataaacaattctttcctgtctgaattattctttctctcatgctggaattttggaacattttacaacttacatttaagaaggctagtttaaaaagaaacagtggaaatttccaccttttaaaaaaacttaatttctggtctattaactgctttgcaggaagaaagaaatatgaagaagaaccgcagacattctggatgtcagcctgtgaaattttccactatttcccataataacatgcaggcacgcttatactgctggattcattgcaactgcagttgcactctgagtggaatttgaagctactcttatcagtgataaaatggcatgtagcttttaatgagcagtgcatatattttcacatctaaggtattgtatgtttgtttcatctctgcctgaatagtgtggccataaacactgaaattgtaaaattatttttaaaacttctgattccaaaattcctgattgtttcaaatggttttgattgttttatttcagtagattatgtatctgagaagatatataatcatccttttagttacagtgctgcatacataaaattttacagggttttatacatacagaagaatgatgagaaaattaaagttttaaaaggatttgtatagaggagaaaattgagacaaagttttaaaaagatttgcatagctcagtattttggtttgattcaataaatttttaatgatttaactttttttttttttttttttgagacagagtcttactctgtcacccaggctgtagggccgtggcacgatcttggctcattgcaacctccgcctcctgggttcaagcatttcttctgcctcagcctcccaagtagctgggattacaggctcccgccaccatgcctggcgaatttttgtatttttttagtagagacaaggtttcaccatgttggtcaggctggtctcaaactcttgccctcaagtgatccacctgccttggtctctcaaagtgctgggattacaggcgtgggccactgcgcctggccaacaattttaactattttaggttcctgttaatcttttaaaatgtcagtagactttatattaaaattgatgctgtgtttttgtttggctccttgaaatttaaaggcaaacaaggtgttattatccaacttttctaatgatgtaagtccaggtttcctagatctgtaaactggcgtagcagtagggtgaagagtagattacaaatacattgtaattatctaccctgtttcatctttcatctcttccatggctaatgcctaacattggtattaaggaataaaattgaggaatttggctgggtgcggtggctcacacctgtaatcccagtactttgggagactgagggcaggcagatcacttgaggtaaggagttcaagatcagcctggccaacgtggtgaagccctgtctctactaaaaatacaaaaattaaccgggtttggtggtggtcacttgtaatcccagctactcgggaggctgaggcagaagaatcgcttgaactcaggaggcagaggctgcatgcagtgagccgagattgtgccactgtactccagcctgggcgacggagcgagactatctcaaacaaacaaacaaacaaacaaacaaaaagaaattggggaattcaagatatataaatgaacctttaaactgcacttttgcagagaggaatttaagggttcaaagtgatgaaacagatgtattacagatatctttctgtgtttttacacttgcacatcactgacattttggaagtaaagccatattaatgcagaagtatatctcttctggactgttgggctagatttgagcaagaataatgttgtgacataacagtgttctccatcccttccctgtgatctgctcctcccttgtacagtctcatccttcctcttgacctttcctgtatctataacttttctcttgacctcttcatgcacttccccttctcagctttcctccagtctgcaactgtcttatcccttccctcagcctaaatttccgtctggcttgtaacctttttacctctgtcaactttccatccttcaggtccctcactttttctggtttctcactgttaaccaaggtcttttctttacctttggaagcttctttactgcgtgtgttctctgctcctgtcagattgatttttgtttagtccttgacccctcaaacgtgtacatcctcacaccctccaaaatcctttaactttcatttcttcttccatgctttaatttattctgcaaaaatttattgagtgctagccatgtgttgcctattccttagatgttaggaatataccagtgactagaaaggttacggaaaaaaaataaaactttgtagggggggacttgtgtgtgtgtgtgtgtgtgtgtgtgtgttgcagggtttacgttttagatatcatggtaagttttgctaagtaagtgatacttaaacaaggacaccaggaagtaagtaagccctgagaatattgggttggggtaaggttgggatggggagctttctgtttagagggaactaccagtggaaaggccctttgttaggagcattcttagtgaatttgaagaacagcaaggtgaccagtgttttggagcacagtgtttggaggacagtgaacaaagacgtaagtagcaagagaaatctgagaggtaacagtgaggccttgcagacagttgtaaggacttcaactttaaaaaaaattcattttttaaaaaatagcataatagcatataaatgcatggtttccattattttctttttgagatgggatctcattatattgcccaggcccaggctggtctagaactgctgggctcccacctcagcctcatgggtagcttggcctacaggtgagtgttaagacgtgcagctaattaaaaaaatttttttttcttgtagagacaggtcttttttgctgcctagtctagtcttgaactcctgacatgaagcaatagtcccacctcagcttcccaaagtattggcattataggtgtgagctatcatacctggcttcctgcagattttttaattgtatttttggttattccaaaaagatcatttggctgggcacggtggctcacacctgtaatcccagcactttgggaggctgaggcgggcggatcacttgaggtcagaagtttgagaccagcctggccaacatggtgaaaccccgtctgtactacaaatacaaaaaaattagccacacgtggtggcgggcgcctgtaatcccagctactcgggaggctgaggcagagaattgcttgaatctgggagacggaggttgcagtgagccaggattgtgccattgcactccagcttgggcaacagagcaagactctgtctcaaaaaaaaaaaaaaaaaaaaaaaaaaaaattaaccgggcgtggtggcaggcacctctgtaatcccagctactcaggaggctgaggcaggagaatcatttgaatttgggaggcggaggttgcagtgagctgagaacacaccactgcattccagtctaggtgacagagccaggttccgtctcaaaaaaaaaaaaaaaaaaaagatcattgatttttttttttctttttccccttcaaattaaagcatttcttttttctttggttgtaaaggtgattaattcatgttcatgtggaaaacatggaaaatccagaaaagtacaaaaaaataaggattactagcaaccgcatcatccattattaatagattttgtatgtatatctttccagtctttttttctttgttcttttacacatacacagtgccttatacagtatatgggtttagcagagattaaatgaactctatcagggtcttcataagaccctccagcagtcatgtgaagagtagcctgtaagagtgcaagggtagaagcagggagagctaggccaggtgcactggctcacacttgtaaccctagcactttgagaggtcgaggagggtggatttcttgagcccaggagtttgagaccagcctgagcaacatagatcctatctctacaaaaaatgcagaaattagcccagcatggtggcaggtgcctgtggtcctagcttactggggaggctgagctgggaggattgcttgaacccaggaggttgaggctgccgtgagctgtggctatgccactgtactccagcctgggcaacagagcaagaccctgtctccaaaaacaaaaacaaacgaaaaaacaaaacacaaaaaacccaggatgacctattagaaggctgttagagtaatccatgttggtttagactatgattatggcaagagaggtgataagaagtggtcagattgtatatatcttcttttgaaggtagagccaacaggattttgtgatggtttcagtggggggggcggggggtgaagagggaagagaagaatcaagcataattcaaaagtttttggcttgaacaactagaattgtttggcttcattttcttgtcaaactacccatccaaggctcttttattgtgtccttcctgtccatttgaacttgggattctttaaaaaaaaaaaaaaaaagatttatttgctctatagagaaaccaaagcatgaacttgtgattatttctttcaccaggcttctagtttgtgctgtccaacttggtacttggtacccaccacaagatgctatatataacaagtgtttcactagcattagtctccctaactgggttgtgagcatccttttactggatcatgctgaatttgagtcttttcagggacctgtaactttctgagtacgttgtggacgttcagaaaatgtctatttattgtatgtttttcaggcttaagaataagatatgaaaaaacctcaaagtaactgtctgcttttactttagattactgacatcttttgagaatgtgtttgggccagatgagctggttcacacctgtaaccccagcactttgggaggctgaggcaggcagatcacttgagcttaggagttcaagagcagtctgggcaacgtggcgaaaccccatctctaccaaaaatccaaaaaattgtctgggtgtggtggcgtgcacctgtagtcccagctgttgggtggctgaggtgggaggatcggttgagcctgggaaatggaagttgcagtgagtagagatcatgccattgcactatagcgtgggtgacagagtgagactccatctctctcttttttttttcttaatttataaaaaaaggtgtttggatagttattttccttatatccagtgtaagaatcattacaaggtctggctgtgttgcccaggcttgtttttttttttttctttttaaataattagcgttattattattcttagtttttgagtcagggtcttgctttcttgccagacttgagtgcagtagtgcagtggcacaatcatggctcactgcagcctcaaactcctgggctcaaggaattttcccacctcagcctcctaagtagctaggctcacttcttccgtgcctcgctgcccaaacccctagggggagcatgcagacggacaggtcgtgaggagtgtttttgggctttgactccatagcagcatctagggttgagtgtttccagctcctgaagccccagtggccgtgtgttacagtgtgctctttcagttttgtggtctacaggtggcttgtgccaatcagctgagttacactctctgccttatcgcaaggatagagggctctctgtatcccaggttcttgccctagtgtgctggaaagatcggatcacacacggacttggagaatgagtgcaaggtttttttgctttttttttttgagaccgagtctcactctgttgccaggctggggtgcagtggcgcaatctcggctcactgcagcctcctcctcccaggttcaagtgactctcctgcctcagcctcccgagtagctgggattacaggcatgcaccaccacatctggctaatttttgtatttttaatagagatgaggtttcaccatgttggccaagatggtcttgatctcctgaccttgtgatccgcccatctcagcctcccaaagtgctgggattacaggtatgagccactgcgcccggccgagtgcaaggttttattgaatggtggaagtagctctcagcagatggatggggagccataagagggatggagagggaaggtgatcttcccctggagctgggctgcccagcagctggactctactccgaccaccccctatcaaattctgcatcaacttaaatgtagatggctggctggcgctgctggtgtctgtcagtgtgctgttctgctcctctgttcctctcgatgtccagccgcttgtgtgtgtgtctgcttaaggtcctgggcttatatgagcacaagataggggggcatggcaggccaaaaggcaactttttgggtgcgtaaacagaaatgcttgttctcacttaggtccgtgagcacaggcccgagggtggagcactcaccatgtaccctactcatctctacccagcacttacttccctgcccttctcccatatcaagactacaggtgtgcacctacatgcccagctaatatgataaaatttttttgtagagagtgtcttgccacattgtccacacctcaagtgatcctccttccttggcctcccaaagtgttggaattactggcatgagccccctatccggccagtgaatgttaatgcttacctggtatatgcaaagcatcctaggagatagaaagttttgcaagaaaaggtccctgcccaaaaaggagcttattttttggtgcagacaatatatcctatacacattttgtctcctttacaggaaaataatgtattatcatttactgcaaaacaaattgttgtcatgcctttgtcattctaaagcttgtaggggctctttgcctctttattaagtgatgattgatatctgtgctttgagttcttatttatttgtttttaaaatagagatgagtctcactttgttgcccaggctgatcccaaactcctggtttcaagccatcctcctgcatgggcctcctaaaatgctgggattacaggtatgaagccattgtgcccagcctcactgtttttttcttttttttttttttttttgagacagtcttgctttttcactcaggctggagtgcagtagtgcaatctcggctcactgcaacctccgcctcctggattcaagcaattctcctgcctcagcctcctgagtagctgggattacaggtgtgcgccaccatgcccggctaattttttttttttgtatttttagtagagacggggtttcaccatgttggtcaggctggtctcaaactcctgaccttgtgatccatccacctcggcctcctaaagtgctgggattacaggcgtgagccaccgcgcccggcctgttttgttttaagcaaagaagttcttcatatttatagatgctgtctggtttagaggatatgctatctatccatatacaactgagttctctacatttccttggtctggaagggactaaatcttttagacaaggagaaggaaagttggtaaaagtagtgcttttcagttacgttctttacttgtagcgttgtaaagaacttatcagagaagtaaattgagtgtaatttacttttgcctgtggtcatcacttctacctcttaatggagtgtttttctatagaaaggttatagaatgtaactcaaacttttatttttgtgataatcggcgggggtgggggggggaagtgttgggaaaacaggtgtgagccattgcacctgttctattttatattctgctaggaaagaaaatgtaaaactgccaaattagctagttcaacaaatgaccacctataaaaaccaaggggtttacatagggttttttttttttttgagatggagtcttgctctgtcgcccaagctggagtgcaggtggcacgatctcagctcactggaacctctgcctcccaggttcaagtgattctcctgcctcagcctcctgagtatctgggactacaggtccttgtcaccacacccggctaattttttctacttttagtagagattgggtttcactgtgttagccaggatggtcttgatctcctgacctggttgtgatctgcccgcctcggcctcccaaagtgctaggattacaggcatgagccactgtgcctggctgtttgtttgtttgtttgagacagagctttgctctttctcctaggctggagtgaagtggctcaatcttggcttactgcaacctccacctcctgggttcaagtgattctcctgtctcagcttcctgagtatctgggattacaggtgcctgccaccatgcctggctaatttttgtatttttagtagagacagggtttcactatgttggccaggctggtcttgaactcctgacttcaggtgatccacccaccttggcctcccaaagtgctaggattacaggcatgaaccaccgcgcctggactaataggtttttaagctctaactttgggggaaaaaaacccaagatgattaaaaatgtcccatttagatgatctttagttgacttgacacaagtcttttggtctggactgctatagtaattcacgatgtggtttttttaggcactgcgttagaagcgaagaataatattaatttatttggggtagagagtagtggtgaacctgacttgtaacattctgtttaagagagtctgatgttccagtctgtaactgcaattggaagagctttggaaaaatgatttgtggacacataagatactttttaaaaacataattttctctgcctccttaaagaagtttgtgtttcttaaataaccagcattattactattcttttttttttttcttgagacacctgtcacccaggctagagtgcagtggtgtgacctcagctcactgcaacctctgcctcccgggttcaagtaattctcctgcctcagcctcctgagtagctgggattacaagattacaggcgtgtgccaccatgccagtctaatttttgtaattttagtagagacagggtttccccatgttggccaggctggtctcgaactcctgacctcatgatcctcccaccttggcctcccaaagtgttgggatttcaggcgtaagccactgtgcccagccactattcttctctttcagatgaatctaaaagatgtttagttttcagaaactggagaagatgttatattctcacttttccctgttaagtttcagcatctgttctggctgttttactttttctcaaaccttttatttagaacaaaaacttggatgaattgatttcaagacttcactttgcctttgggtaaggttttccttagtggtttgcctgagttgtgttttagtatctttcttgggttgcttagctttttcagcctttgggacaatctgttgacttagttgtgaattttagcttttcatttcttgtgccatagaatttgtatgtgctgccaggcatggtggcatgttcctgtagtcccagctacttgataaggtggcttgataagctacttgataaggtggtaggaggtagcttgatcccaagagtttgaggctgcagtgagctctggtcataccatcgtactatatgtagcctgggtgacaacgataccctgtctccaggaaaaaataaaataaaagttatgctaatagaacataaactatttgaggactgggaggtatctgttttgtttactgctatatccttagtgctcagaatggtggcagacacatagtaggtactcaaatatttgctgaataaatttagagtagcagtagcaggtttttatttattgagcacacactgaatggcaaagtgctaagctctttgaatggatttggtggtttttccattttatagcttgttttctgttcatatgatagtttatgaatgggtgtgagggaggaaggaggagatgaagccagcgttgttgaggatgctgctagctattaccaaatttcatcaagtttaagataccatcaattatagaacacaacattattttacgtattactaggtctcaaactcctggcctcaagtgatccgcctgccttggccccccaaagtgttgggattacaggtgtgagccaccgcacccggcctattttatgtactactgggaaagaaaatgtaaaactttcaaataaataattggatactgccaataacatgacatattctgattttaaagatgtaaaaatatgaacaaaccccaaaatatttaagggatactagttttacataaactctcatttaacaatcatgaaaccttctagagttggatattactatcttcatttgagagaggaggaaattgaagctcatgggttaattacataagctctccagtagaggatccagattgaggtctctcagatttcggaggccatgccctttttaccaccctacattgccttaggagtcaaggaaataaaatagtacattggcctgtatgtcaactttggcttgaagatagtcaactttggcttggagatacttagttggcatggctttaaacattttctttgaaatggatttttcctatttttccttaaaatcaaatatcttggctggggcgcggtggcttacacttgtaatcccagcactttgggaggccgatgagggtggatcatctgaggtcaggagttcgagaccagcctggctaacatagtgaaacccccctctactaaaaatacaaaaattagctgggcatggtggtgggtgcctgtaatccggctacttgagaggctgaggaaggagaatcggttgaacctaggaggtggagtttgcagtgagctgagaccgcaggattgtactgcagcctgggcaacaagagtgaaactcttgtctcaaaaaaaaaaaaaaaattcaaatatctttgtatttactctgtgctagctactctgtgggtctgtgtgtatacaaaacaatataaggtcttatctcttcttctcaaggaatttatagtctgtttggggagatgagaactaaacatgaaagataactagagaagatttaaataacatttcagagaataatgcaagaggtttaacaaggcagtgaaggattaattgccaaataaattgtacaaataattgcttttggagttcagaggaagaaatgattgtttggggctggggtaatctagggaaggatgtaaatgaattcctgggagatattttcagttagtgagattatttactttacctttaaaatcatattaatgtttgttacaaatggaactgcaaactgtttgaacatgaactattgtatcttaatttttttaaatctccatatgagagtgcaggagctactaccccagagaaaagtagatcatgctttctacatgtatttgcttctattgtatcaagtagatggagaaagtactcagttttagaagaaaaatctttgggtgaaaaaaaagaggaactccctgtccctaaattccttcaatgtcactcttgccacgttttcaatcagttgtactttgtgagtcattgccgaggtcactttttgtgacttgtagcattcatgattaacttctaaagggtggaaacaagcattaatcccctttacatcactaatgttctctctgtcccccctccccctcctttccccactctcccctcccccctcccctcccctcccctcccctcccctcccctcccctcccctcccctcccctcccctcccccctcccctcccctctcccctcccctcctttctcctcccttcccctctctctcctcaggctcaaaggatcctcccacctcagtctcctgagtagttgggaccacaggtgtgtgtcactgtgcccgtttaatttttaaatttttttgtagagatggggcctttctatgttgttgctcaggctggtctcgaactcctggcctcaagttaccctcctgccctcaagttaccctcctgccttgcaaggcctcccaaagtactgggattccaggcaatactccttcataccgttttgaagcaaatactagacattatataatttccttaagtatctataaaagatacaactgtctttcataaaaagcaaactctacattattacatctagaaaacctgcattaatttcttagtagcatcaaatacacagtcacttcagttttctagttctcctcattttttaatttgttggaatcagattcaaacaagatgcagacattgcaatttggtttttatgcgacctaagtttctgttaatataggttttctcttcatctcttttttccttccaatttatcaaattattttttgccctgtagagtttttttttttttttttttttgttgttgttgttgttggagggacagagacttattctgtcacccaggctggagtgcaatgctgtgatcatagcttattgtagtctcaaactcgttggctcaagcgatcctcccacctcagcctcccaagtagctgggattaaaggtgcacaccaccatgccagctacattaaaatttttttttttttttggtggaaaaggggctcttgctatgttactcaggctggtctggaactcctggcctcaagtgattgtcctgtcttggcctcctaaagtgctgggattacaggcacaagtaaccgtgcccggcttcctgtagagtttcttattgtctggattttgcaaagtatgtctttgtggtggtttttcagtgtgtcctctgtcctctctctctctatttttaaaatggtagttagctttcaagtcttgatcagtttctggttcagttattttttacaagcatattcattatctgttgctgtgtaacaaattatctccaaacttgacatcttaaaccagcatttattggtcccagcacctcaggaaactgaggtgggaggactgcttaagcctggaagtttgaggctgcagtgagctgtgattgcacctgtgaataggcaattcctaggcaagaccctctctctaaaaattggccaggcatggtggctcatgcctatagtcccagcgctttgggaagcccaggcgggtggatcatttgagccccggagtttgagaccagcctgggcaacatggcgaaaccccatctatacaaacaatacaaaaattatccgggcatggtggcacatacctgttgtcccagctacttgggaggctgaggcaggagggaggatgtcttgagctgggacgtggaggttgcagttggctgagaacacaccactgtactccagtctgggtgacagcaagactctgtttcaaaacaaagcaaaataaacctcccaaactccttagtatttattatcttccacagtttctgaaggttaggactctgggagtagcctagctggggagttgtggttttagtactcttaatgggttgcagtcatctgaaggtttaacaaaggctggaggatttgcttccgaggtggcttactcagtgaccattggtgggaggtctcagtttctgcctgagtgtcctaaagctactgccagagctagtgatcagagagaaggagaaaaggaggagggaatttgaaatgcctttgtgacctcagaagtgacagcttgtcacttttcttttggtcacatagaccaactttgatacagtatgggaggggactgcttaagttcatgaatacctagagatgggtgtcactggggatgtcatcttggtgctggctactacagtgagactacttcccagggagtgtggtttatcagaagacacatgacgtctgtttttctttgagttgttaatattagcagatactataaagaaaaactttttctttctttcttcttcttcttttttttttttcctttggagagagtcttgctctgttgcccaggctggagtgcaatggtgggatctcggctcaccgcaacctccacctcctgggttcaagtgattctcctgcctcagcctcccgagtagctgggactactggtgcgcaccaccacgcctggctcagttttgtgcttttagtgtagacggggtttcaccatgttggccaggctggtctcgaattcctgacctcaggtgatccacctgccttgtcctcccagggagctgggattacaggcgtgagccactgtgcccagccaagaaaagctttttctaatcaagtatttggtcacctggtgtgggtacagtttacataggaaagatgtgatatatgttagactctatttactagtatttaaaataacaagttggtttactagtattctcctgtggtaaaaaacattttttttctcaaagtttaaaaaaaaactattttgaaataattttagacttttgggaatgttgcaaaaatagtagagttttcctgtgtactccaccccgattcccccaatttaataacttgcatagccatgttatagtgatcaaaactaaggctaacactggtataatactgttaactaagtagcagatattgtcaaatttccactcttgtgtttttttctgttccaggatccaatcctattctttattaatctctcccttttgtttttttggggtttattttgttcaagtttttttttttcagttaggtgtaggatggatgttcatgataatgtatctttatttgtcttttatttaatactactttttttttttttttttttttcccttaaacgcagggtctcactgtcacccaggctggaatgcagttgtgctgacatggttcactgcagcctcaacctcctgggtttaagcggtccttctgtgtagctgggaccacaggcatgtgtcagcatgcctgactaattgttgtgggtatttaaaaaaatttatgaagtttgtattttgttttagatgttgcctttatattaaaatccttatgtaatagacttagtgcccccccaattttttggttattttctgttggtttcttactttgaatactattgaaattacctagtaacttctttttcttcccaagcatttgatttaaagtaatatctttttctttcagttgatatcaggtaatcagccagttttttttccagtttttatctcttcatacttcagtttatggatagttgtgctctagctacaatgttggaacatatagtcattatgtagtataaagtgtcacttagaaccctcattcaggtttttacagataaatatatatttaatgcccactaccatttttatgttgatatggactttccagttatttgggtcatctggaattcattttctctaataaattcctcaggaagagcttatgggaacagtattccttgtgttcccctatgtttgagaagtttgtctgcagctttaatagttaaaagctggcttggtgatgataaaattctgttccacagtatctgaaatatgtcattccactgtcttctggcacagagcatagctgttacagtatgatgatgtcgacctgtttttctttgagcaatgtagctttttttttttttttgtaattgtttagatatccataggattttttttttttttttttttgagaaagagtctcactttgttgcccaggctagagtgcagtgacaggatctcggctcactgcaacctctgtcttccgggttcaagggattctcctgcctcagcctccctagtagctggaactacaggcatgtactaccacgcccagctaatttttgtatttttagtagagatagggttttgccatgttgtctaggctgatctcgaattcctgacctcaggtgatccacctgctttggcctcccaaagtgctgggattactggcgtgagccactgcgcctggcctttgtaatcttattggtgttggttggtctgacacatttttccttgggcattcagtgagtcttttcaatatgtattaatagtttcaagcttccttcccctcttctttttttgtctctgtttttctcaatatcatgaaggttttcttagtgctgttttttttttatttgctttttgttttttttgtcttactgccttggttttcttctttgggattcctactatacatatattggatcatctttgtgatatatatatggagacacggtctcggtctgtcgcctaggctgaagtgcagtggtgtgatcatggctcattgcaacctccacctcctgggctcaagcgatcctcctgcctcagcatcctgaatagctaggactataggggcatgccatcatgcctggttaatttttgtattttttatagtgatggggttttgccatgttgcccaggctggtctagaactcctgagctcaagtgatcctcccacctcaaccttccaaagtgttgggattacaggcatgagccactgtgccaggcctgtatattgtttatgtgagataaacctctcttttgtttcctcacttgtatatccaactgtcctctgaaccttttcatttagatttctaatggacaactgaaactcaacatgtcccaaaccaatctcatcattttccctgtaagatcttcactaaagccttttctttctcattgttggtaattcattcttgctgttgcttaggcttaaaaaccttgactactcttttatctccttgctatttttaagatatatgtagtgtctggccacatctcagtaattccattgaaccaacattttctgtgagttattgtaataacatcctaataagtcttcctgcattttactcttgtttccttgtatcctgttagtaacgtaacagctggagggatcttttacaatcctaaaccggtttgtcattcctctcttctagactatgtagaggtttcttatttcacccggagtagaaatgaaagttcttactttgtttcaatgagactctgtgacttgcctctgtttttttttttttttttttttaagaccgaatttccctcttgttgcctaggctgaagtgcagtggcgcagtcttggctcactgcaacctccgcctcccgcattcaagtgattcttctgcctcagcctctcgagttgctgggattacaggcatgtgctaccacgcccagctaattttgtatttttagtagagatggggtttctccatgttggtcaggctggtcttgaactccctaactcaggtgatcttcccgccctggcctcccaaagtgctgaggttacaggcatgagccaccgctaccggcctgcctctgttacatctctgatctcacctatcattcctgtcttccttgttcattcttgatccagtaccgttcttcatccagtgcaggcacattcttgcctttgggtatgccctttcttggaatgtttctgtcatatgtctgattaagttcctcatctctttaaagtctcaattcttacactcttaatgaggcccacccttaccaccctatttaataccggaacctctgaccttatagcactaatgctctaatatattaatactttacttatttattgtgtttaattataaagcatatgctccacaagaacaagaatcctagtccccattgctcactgacatatctcaaacacttaggtaggtgtctggcatatggtagatgttcatcattcatttgtcgagtgaataaacacactctgtatttccttgaaagggtgacgtcctaaagcccttctcttaccccatctgtggcgttaagatgtttttctgggtcacagcatatcgtttctctttaaaccctgtggtgggagtactttaggaaagttcctagtttttgttgattttattttatttttatattattattattattattattattttagacggagtctcgctctgccacccaggctagagtgcagtggtgcgatctcggcttactgcaagctccacctcccgggttcacaccattctcctgcctcagcctcctgagtagctgggactacaggcgcccatcaccatgcccgactaattttttgtgtgtgtgtttttagtagagacagggtttcaccacattagccaggatagtctcgatctcctgacctcgtgatccacccgcctcggcctcccaaagtgctgggattacaggcatgagccaccgcgcccggcccgttttgttattttttgagatggagtgtcgctctgtcacccagactgaagtgcagtggcatgatctcagctcactgcaacctccacctcctgggttcaagcgattgtcgtgccttagcctcccgagtagctaggattacaggcgcctgccaccaccccctgctaattattttattttattttatttttatttttaataaagatggggtttaccaagttggccaggctggtcttgaactcctgacctcaggttatccacctgcctcgacctcccaaagtgctgggattataggtgtgagccaccatgctcagcctttgttggttttattttagcttcccgtctctttaggctggaactgtttctagaaatccatttaagatggaagttgactctgaaattggttaaataaagttagggtgatttgttaatatagaggaattgtgagttaccacctgtcatatatataagagaatttcttatttgttttcttactctctaagcctaataaaaaaaggttcctttaaaaaaaaaaaattcattctaggccaggtgcggtggcccacacctgtaatcccagcactttgggaggttgaggcaggcagatcacctgaggtcaggagttccagaccagccagcccaacatggcgaaaccccgtctctactaaaaatacaaaaaattagctgggcatggtggcaggcgcctgtaatctcagctactcgggaggctgaggcaggagaatcacttgaacctgggaggcagaggttggagtgagctgagatcatgccactgcactccagcctgggtggcaagagtgaaactccatctcaaaaaataaaataaaataaaaataaaaattaaaaaaaaatcttttttactgcattttcagtggcagtttgagaagaaggggtggtacatgtcgatagacattaacatgcaattgagaaatgcttttaaaaaagtgtgcatgtatattatgccttctcaatgtttttattctgtttcagcaaatcagtagagttgcagtaatctagaaaggattaattatgtcatgatggtttactgtgtagtctccccaagaagggccactctgttctgcgtactgctgttaggcacaagatgtgaaataatatctgtgaggtcttcatttggtgaatatgataaaatcaatagcattttaaagggtctcctaaaaataccatttaatgaattttaaaaattaatagtgaattattattattgagaacatttgttaaattagtgttttcttggtttggattggatgtaatgcataaacttcaaagatgtaaaaactgtatttaaaacattttttaaattttttgtagagatgggggtctcaccacgttgcctagggtggtctcgagctcttgggctcaagtgatcctcccacctcagcctccaaaagtgttagattacagtcctgagccatcatggacttaactatccttaattttgtatcacctatggagaacatgtattaactttgtaataaaaaagtttttaggcctggtgcagcagctcttgcctgtaatgccagcacattgggaggctgaggtgagaggatcacttaagcccaggagtttgaggccagcctgggcaacatggcaagaccccagattgacaaaaaattaaaaaaaaaaattagctgggcatgatgtggttaaaaaaaaatttatctgggcacaggatgacaggtacctgcggtcccagctacccggaaggctgagacatggcaatcacttgagaccaggaggttgaggctacagcaaactatgatctgtctgctgcactccatcctgggcaacagagcgaagactctgtctcaaaaaaaaaaaaaaaaaaaaagtcttctgtattttgtataaattggtggtggttggatctagaggcttgagcacagatgatttaatgagatcagtttccaggtttgcagattcacaaacctttgttctcttaaattcttcttctttcttctcttttttggggacagagtcttcctctgtcaccaggctggagtgtagtggcacaatcaaggcttattgcagcctctacctcccaggctcaagaaatcctcccaccttagcttcttaaatagctgggactacaggcgcacgccaccaccatgcctggctaatttttgtaattttttgtagagacatgatttcaccatgttgcttaggctggtctcaaactcctgagctcaagcagtctgcctacctgggcctcccagagtgctgggattacaggcgtgagccactgtgctggctgttcttttaactttttaagttggcctgagaaagcttgcagagccttattctccagatgtctctttttacaattattcttctaactgccaaaagaagtaagaagtctcccgttttactgtgttgtatttcaatttttttttttttttaaaagggtttgaagtccaggcgcggtggctcacacctgtaatcccggcactttgggaggccgaggtgggcaaatgacctgaggttgggagtttgagaccaacctgaccaacatggagaaaccccatctctactaaaaatacaaaattagtcgggcatggaggcacatgcctgtaatctcagctactcgggaggctgaggcaggagaattgcttgaatccgggaggcagaggttgctgtgagctgagatcgtgccattgcactccagcctgggcaacaagagcaaaactccgtctcagaaaaaaaaaaaaaaaaaaggtgggggggtttgaaacacatgggcaattagaaatactggtgtcagagtttaacaagtgaatgactctcaatgactgattaacaaacgacctattagttggtttctaagtgtgttttcatcagaattgaggtggaagttaatcaaattgctctctgagagatcatgaaaacataatttttgatggtagttcactgagactcttatcatgtaattaagattatactgaaagaattgaatgacatcgctttcacataactccttccatgtatttaatctacttatgtcagcacattttaatcttacaaaaaatgagtgcatgtcagtggtgggagaaggacaaaacatcttgctcattgtagcgaacagattcactgacagtgaaaagtgtatttttatgtatatattacccaaatttgtaatatgtttatgttttgaacaattacatcctaataatgatcatagtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaattttatatttcaggagaaaggaagagttgtagaatttctgacttggagatgatctaggttcttttcaatatgtaagagtgatataacaccttattaaaatgctaatgctcataatatcttggaagtgactacttcgtaactaaattgatgaaaaatttaaatgtcaacttgcaaatgttctggggcccatagtttttcaagaatcttctggtaggtacttgagcaaaaacattcaagtcctttggtacctgtttgttgtcaggctccgtgctggctgtgttggtgatgtaatgacacgttccctgaattgacacattcccatctttcaagcagtagactttctacaacaaccaacttaatttatgtctgaagcaaagacgtataactgtacacactaaagatctttacatttcgtgtttttataaacagaattacaaatgcatattttgtatttgaaattttaagacccctcacctccaggatgtgtgtgtgtttctttatgaaagtgcaggctggaagataaattttcttactaagatgaatgtttctttttgacagtgattaaaagatgattaaaatagtggtgattctgttgaaaaattttaaacatgtattttttaaaaatggaaaaacattatttgtgtatgccatagcaatttattttgcccacgtaggaaacagaaagggaaaagaagaatttttatatggttcaatattttactgttaagataacttaatacgtatgtatccttccatgaggaataaataggaaggctaaaatagaaaggttaatgtaaacattttttaaaagtaaattgttaggttttaaaaaaactttaattttactgttgttttttgggctttaaggaagctctgtatctctaggtttttaaatcctaatgtaccaggttggcccttttgctgaggatgaggcacttctgtggcagtgttgccatggtgactgcttgccaagtgctgtctcaaggtcactcatcactcatagccctgaatacttggattttgttaagggaaaatatcaacactcagttgataaaatgaagttaattatcatatcacattactgaagcatatctagcaaagttatacttataaacagcattttgtgttagtattgatgaactgtatgtttttgaatattgagttttaacctgccagattagaaggccaatggaaaatctataaattagccatagcccatattgtaatactttaattttattccatttctgactttaaaaaatgcagcagcgtaattttactgtggttatgtttgaagatatctaaacatatttccctcaatatttgctttttgatatgaggcaagagcaaagatttcttagcatttattttatattttggtaaacttagcttgaagttgccagttgctgaagcccttgtccatataagaacaggatgatcattatattttccccaaaccagattgcaggtagatagtagatctatctacctaggttctatttcatatattctttgtctcatactgctgttaattttccttgtccttactttgtaggttttaattttttttgttatatacgaacattatacaagaaaagctgttcattaaaggtttttgttgtttttatcaaaccagttttcaataaaggaatatatgaaaagaaattcccctttgcattagcctatatttcatctgggtcttgttctagagagaaaatcagagctatgtgtcttcattaggatgaaaggtgactttgaaatcagagatgagaagcattactgtaaaagggaaaaatgtgattgaaacaaacaaaaacatgcttttcaaaatacatggttagatttttttttttttttttaagacagggttttgctctgtcacccaggctggatggagtacagtggtacgatcttggttcactgtaaagtctgcctccagggctcaagggatcctcccacctcagcctcccgggtagctgggactacaagcacacaccaccatgtccagctaattttcgtatttttatgtagagacggggtttcgccatgttgctcagtctggtcttgaattcctgggcttaagggatttgctcgctttggcctcctgaagtgttaggattacaggcgtgagccaccgtgcctggcctgaaaatctggtcttttggctaattagaatctaactagttcctctgctttcaagggaattggatgaattggttctcctaaagcattttcatctctgcttctgtagagcagacacctttgcagtgtccgatcaagatacttttacactcttgaaaattttttttttaaattattattattatactttaagttttagggtacatgtgcacaatgtgcaggtttgttacatatgtatacatgtgccatgctggtgtgctgcacccattaacttgtcatttagcattaggtatatcacctaatgctatccctccccccctccccccacccacaacagtccccggtgtgtgatgttccccttcctgtgtccatgtgttctcattgttcaattcccacctatgagtgagaacatgcggtgtttggttttttgtccttgcgatagtttgttgagaatgatggtttccagcttcattcatgtccctacaaaggacatgaactcatcattttttatggctgcatagtattccatggtgtatatgtgccatgttttcttaatccagtctgtcactgttggacatttgggttggttccaagtctttgctattgtgaatagtgccgcaataaacatatgtgtgcatgtgtctttatagcagcatgatttataatcctttgggtatatgcccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcgtgactttttaatgactgccattctaactggtgtgagatggtatctcattgtggttttgatttgcatttctctgatggccagtgatgacgagcattttttcatgtgttttttggctgcataaatgtcttcttttgagaagtgtctgtttatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctctttagtttaattagatctcatttgtcaattttggcttttgttgccattgcttttggtgtttagacatgaagtccttgcccaaaatctccttaagctgataagcacttcagcaaagtctcaggatacaaaatcaatgtgcaaaaatcacaagcattcttatacaccaataacagacaaacaaagagccaaatcatgagtgaactcccattcataattgcttcaaagagaataaaatacctaggaatccaacttacaagggatgtgaaagacctcttcaaggagagctacaaaccactgctcaatgaaataaaagaggatacaaacaaatggaagaacgttccatgctcgtgggtaggaagaatcaatatcgtgaaaaaggccatactgcccaaggtaatttatagattcaatgccatccccatcgagctaccaatgactttcttcacagaattggaaaaaactactttaaagttcatatggaaccaaaaaggagcccacattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataatgctgcatatctacaagtatctgatctttgacaaagctgacaaaaacaagcaatggggaaaggattccctatttacactcttgaaatttcaatgaatgcaaagctctatagatattgttgcaaatatgccaggtagtatatatatgccagctaacgtttgtttcatttttgcatatttatgaagccaagtatattatctgatgctatatttgctaatttatttggaaaaaggtgttaatataaaactctgtaagctatgatgttaggcaacatgatctagaaaaaagaatattggagtgggaggccagggccctgcactgatcttccatctttcttttactgtgtgaacttggttaagtcacttgttgtggttcgtgtttctcatttgtaaatcaaggtatttccatttctgttgtgaccatccataattccattgtcagtattctgtgtagtaaaatttggattatcttcaataatggggagaattgtagttcataccaatctaaagtgctgaagctttcaaactgattcctttgattttggatgcagatttattttgtttttccttagatactattaaagtgttttttttttttttttttttttttgggacagagtctcgccctgtcgcccaggctggagtgcagttgcactatctcggttcactgcaagctccgcctcccaggttcatgccattctcctgcctcagcctcccgagtagctgggactataggcgcctgccaccatgcccggctgattttttttttgtatttttagtagagatggggtttcaccatgttagccaggatggtctcgatctcctgacctcatgatccgccagcctcggcctcccaaagtgctgggattacaggcgtgagccactgcacccagcctttttttttttttttttctgaggcagagtcttcctctgttgtccaggcaatggtgtgatcttggctcactgcaatctctgcctcccggattcaagcaattctcctgcctcagccccctgggtagctgggactacaggcatgtgccaccatgcctggctaattttcgtatttttattggagacagggtttcaccatgttggccaggctggtctcgaactcttgagctcaagcattccacccgccttggcctcccaaagtgctgggattagaggcatgagccactgtgccaagcctattaaagttattttgtattccacatgtatatttaaccaggttgttttggaacaagaaggggaagagtttttatgatggaactgtttatgtggcaagtaattagcagtttttaaaatgttttgtgactaactccacaaggttagaattgactgtagaaatagctgctgaaagaatatagagtagaaattgattttgcaatattttgaacctgggcttcaagtagactctggactttttcagtgagaaggaagggttaatgtgcaaaatattttgctttgaagttttcttttcccctttttttgtttgagatggggtctcactctgtcacccaggctgtagtacagtggtgtgatctcagctcactgcaacctccgcctcctgggtgcaagtgattctcctgtctcagcctgctgagaaactgggatcacaggcgcctgccaccatgcctgactaattttttgtatttttaatagagatggggtttcatcatgttggccaggctggtgaagctttctttaacatgtcccattctatagcccaggaaagcattacagtctcaaaagatggtggacatcaatgtttattaaaacattgtttttaaaagtttacaaagtagaatatatgtgaaaagtgaaagctttagaattaaatcctttcatacccatttccgtgcatatataaacacacagtttttactttgttggctcaccttgtacttactctgccattgccatctttttgtcagtatatagagatctttttcatttaaaaaataatggcaaatatgaatctgtggatagtctaataataaaccagctatttgctgttaaaacagtgccacaaagaacatcctttttctcccatctttacccactcctgcagaaatttccatagaacggattcctgaaagtcaaattttttgggtctgtggatgtccaagggatatctttcatatttggctggatttcaaaattgcttttcagaaagctttaatagcttacagtcctgtcaacagtaacacctacttttttcatgcctattttcttgggatgatgatcttatagcagccatttattgagtgcccaccatgtgttaggaattgtgtcaggtgcttaacttggctttctctaatcctgataatcctgtaagatattattttcatccccatttacagttgaggaatttgagggtcagagaggtgaaataacttgcttaaggccgcataactagtaaatggtaacacactggggtttaaaccgccacctgtctgattccaaagtctgtgttcctcttaatcacaaactgtttctaatattgagaggaccatctgtaaataggtgcatatatacaaattgagaatgtacatattttccttcaaattaagtaatatagtcagataatacatagaaagttaatagtccttcaaatcagccatagcccaaacaatatagataattcagtttattgacaaagatatatatgagatataatttctgactctggctttagatgtttaggttttggacttttcaaatgagtataatccttagtggtttcaaatttaacttgaggaaccaatgattacaactaacaatatactgctagtctacaaacccagtctagttaaggatgccataacaaagtgccacagaccgagtggctaaacaaatttattttcttagagttctggaggctagcattccaaaatcagaagtcagcagggttgcttccttctgaagcctctttctttgacttgtagatggctgacatctccctgtgtcttcacatggttttctctctgttctctttgtctaaatttctttctttttttttttttttgagatggagtctgtctcttgttgcccaggctcgagtgcaacggcgcaatctcggctcactgcaacctccccctgctaggttcaaacgatttctcctgcctcagcctcccgagtagctaggattataggcatgcacctccacgcccagctaattttgtatttttttttttttttttttttttttttttagtagagatggggtttctccatgttggtcaggctggtctcaaactcttgacctcaggtgatctgcctgcctcggcgtcccaaagtgctgggattacagacgtgagccaccgcgccggcctaaatttcctcttacaagggcgccagtcatattggattagggccaccctagtgacctcattttgaataggatcacctctttaaagttctgtctctaaatatagtcacattgtgagaggtgaggattaaaacatgaaatttggcagggtgcaaagaactctaccagttcttccactgtttgcatcagtttcagtgtccctatcagtaaaagaagtcacaagccgtcttgaataattggaacccttctgccagattgtctaatgtcagtctcttttttttggatgctgcttcttctaagtcatcttcctcattgtttggcattggttcagaatccctcatctccatcaagttctcttaattcctctggtgtgtgttgtcttttagctcttacatttctctaagatccatatcttaaaacccttcactccctacttttttcacttttttttttttttttttttggccatatccacaacctccatgatttccttgataggctctgttttaaatcctctgaagttatgcacgacatctggacacagttttctccagcaggaatttattgttttggacttgatgcctttcacagctttttccgtaacagtgatggcatcttcaatggtgtaatctttccagattttcatgatgttttctctattagggttcttttccatagcatccataatccttcccatagagcactatgtgtaatgagccttaaaggtccttatgacctcctgatcttcagactgaattagagttatcatgtttgggggcaggtaaaccaactcaatgccttcattgttgaacttataggcttctgggtggtcagggcattgtccaatagtaaaagaactttaaaaggcagtcccttactggcaaggcacttcctgacttcagggacaaagcattgatggattcaatccagaaaaaggcttcttgttctccaggccttcttatacaaccaaaagactggcagctggtgtttatcttttcccttcaagatttggagcaggggagggaggtggtggctagcagcttcttagatgagggcagtcctgatcataaaccctactgcatttgtacaaaacagtagagttagcctgtcccttcctgccttatatcctgatgcttgcttctctttcttactaaatgtcctttgcagtctttttttcttccccagaatagggcactttcatctgcattaaaaatcttttcaggctctgcgtggtggctcacctctgtaatcccagcactttgggaggccgaggtgggcggatcacttgaggtcaggagttcgagaccagtctggccaacatggtgaaaccccgtctctactaaaaatacaaaaaaattagcctcccaggttccagtgattctcctgcctcagcctcccaggtagctgggactacaggcacaccctaccacacctggctaattttttgtatttttagcagagacagggtctcactgtgttgcccaggctggtctcaaactcttcaactaaggcagtcttctcaccttggcctcccaaagtgctaggattacaggcgtgagccactgcactggccaatttttgtatttttaatagagatgggctttcatcacattggccaaactggtctcgaactgctggcctcaatcagtccacccaccttggcctcccaaagtgttggaattacaggagtgagccaccacacctggccttaatttttttttggagacagtttcgctctgttgcccaggctagagtgctgtggcacaatcttggctcactgcaacctttgtctcctggtttcaagcaattctcctgcctcagccacccgagtagctgggattataggtgtgcgctatcatggccggctttttgtatttttagtagagagagggtttcaccatgttggccagactggtctcaaactcctgacctgaagtgatttgcccgccttgtcttcccaaattgctgggattacagatgtgagccatcgtgcccggccatgaggacgtgctttcaagtcaattggataaatacctggaagtgtgattgctggatcatatggttaagttaggttttagctttgtgaaaaactgccaaactgtcttctgaagtggctgtatcatttgtatgctcaccagcaatgaattagagttcctgttactctgcatgctcacaacatttggtattgtcagtttttttagattttagccattccaataggtatgtcgtagtatctcattgttttaattagcagtcctgtaataacagatgatgttcagcatcttcatatgcttatttgctatatgtgtatcttcagtgaggtgtctttagtccatcttttaactagtttcttgtgttactattttgtcattgaagagctctttatatattttggaatgtaaattctcgatgtgttaaacatttttctcacgatctggcttgctttgatttaaaaattttttttatttcaataattttgagttataggtggttttggttacattaatgagttcttttgtggtgatttctgagtttttaggtgtacctgagcagtgtacactgtgcccaatatgtagtcttatccctcattctttttttttttttttttttttgagatagggtctctgtcacccgggctggagtatagtggtatgattttggctcactgcagcttgacttctggggctcaggcgatcctcctaccgcagcctccagcctcctgagtagctgatatcacagatgcatgccaccatactcagctacttttttgtattttttgtagagacagggtttcgccatgttgcccaagctggtctcgaactcctgaggtcaaaggatctgcttgcttcagcctcctaaagtgctgggattatgggcatgagctactgggactggccaattttttttttttttcaagttgacttttttttttttttttaaagctacacggtctcgatctgttgcccagactgcagtgcagtggcatgttcatagctcactgcagcttcaaattcctgggctcaagtgatcctcttgcttcagcttccccaagaagctaggactataggcctgtgccagcacacccagctaattttttttctttttctttttttttttatttcatagagacaggatcttgctatgttgcctgggcttttctccaactctaagcctcaagtgatcctcttgcctcagcttcccaaagtgctgggattacaggcatgagccactgcacctcgcttaggctatttttttaaagagcagtttaaggttataggaaaatggagaggagggtacagagatttcccatatgtgcatgtcttcctccattatcagcaactccctgccagagtggtggatttgttatagttgatgaatttatgctgacacatcatcacctagagttcatagcttacattagggttaattcatagaatgttgtatattctgtgagtttaggcaaatttacaatgatctaccattaaaatatcatacagagtagtttcactaccctaaaaaatctatgccccacctattcatcccctccttccccgtaatctcaggcaaccattgatcattttattgtccccatagttttgcttttttttttgacatgtcatatagttggaaccataaagtatgtagccttttcagactagcttcttttgcttagtaatatgcatttaagtttcctccctgtctttttatgacttgatagcgtatttctttacagtgctgaatgagattccatgtgccacaatttatccactcacctattgaaggacatcttggttgcttccatgctttagcaattatgaataaagctgccataagcacctgtgtataggtttttgtgtgtaggatgtaagttttcaactttgggtaaaacaccaaggagcatgattgctggttagaatatgtttagttttttaagaaattgcccaactgtcttccaaaatggcttttgcattcctaccagcaatgaatgagaattcctgttgcttcacatactttccagtgtttggtgttgtcagtgttctagattttggccattccaacaggtgtgtattagtatcatcatttcagtttgcatttccctgatgacgtgtgatgtggatcatcttttcatatacttgtttgtcatctgtccatctgtcttgatttttttttttttaatttgtgttggcaaatgagggtcaggaattggatttgggatctagctttaaggaattagttagggtttggtattttgaatgtaaaacggcctaggaatgtatataaatcacaactgtaccatataccttttattattttgtgattataaaagcatagcaatcactttggaaaatttgggatactttcaaagcaggaaaaagtactactagtaattgtggggattaacattttgttatattttctaaattcttctttttcttctcctatatattctccatatatctctgtatccttcttttacatgtaattatgcagaacttttaataatattttagaggctacttttatgattattaaaagtaattttttaaaaataatgatgaggtcttgctatgttggccggattggtcttgaactcttggcctcaagcagtcctctccactgggcctcccaaagtgctaggattacaggcgtgagccaacacgcctggctaaaagtaatgtttatgtgagcatcaggtgccacaagctttgtctacatttctcatacttctttgtttagagtactggaagtagattctggatcgaagactactgctggatgttacgaattattttcctaatctatcctttttatattacattaaggagtttaacattttgtagagcttaaaaagttttttggtggcatcatttttgttttatttaaaaattacaacaaaattatttgtcattttaccacttaaaagtcagtgattttgggtgatgataatgtgtcagtgtagtttcaccagttgtaacaaactcaccactctgataggggatgtttatgatggggggaggagatgcatatgtagaaggaatagataggctatctctgtacttggtctcaattttggtgtgaacctaaaactgctctaagaaatcaaaaagggaaaaaaatggtacagtaattaaaccatgccctcaattcagttgcatattaaatttgagtgcaggctgggcatgatggcttatgcctgtaatcccagcagtttaagtggctgaggcatggctgggcacagtagctcatgcctgtaatcctagcactttgggaggctgaggcaggcagatcacctgaggtcaggaattcgagaccagcctgaccaacgtggtgaaatgccatctctactaaaaatataaaaaaattagctgggcgtggtggcaggcgcctgtagacccagctactcaggaagctgaggcacgagaatctcttgaacctgggaggcggagcttgcagtgagccaagatggtgccactgcactgtagcctgggctacagagcgagattctgtctcaaaaaaaaaaaaaaaagaaagaaaaaagaaaaaggctgaggtgggaggatcacttgaactcaggagtttgagaccagcctgagcagcatgaggaaatcttgtctctacaaaaactacacaaattagccaggtgtggtggcatgcgcatgtggtcctagctacttgggaggttgaggcaagaggattgcttgagtctgcctgagggtgaggctgcagtgagccatgtactccatcctggggaaagagcgagaccctgtctcaaaaaacgaaaaaaaaaaaatttatgcacctttctccgtttttttccccaagtatgagcagatacatctatataaacattgttctcacacattaaaacaatcatgttattttgcttgcattttttttttcaattattgtagcatgggcatccttttaggtaattgtatatggacatctactgcattattttcaatggctatgtaatatactgttgttggatgtcctttatttagtcattcatctgttaattcagcaaagaactattgagtacctgtcatgtgcaagttactggggatatattcaacaaacagaacaaactgaaatctctcacctcaaggagcttgcatcaagttggagtttatattcccctattgatggtcattatttatttctcctcttttttttttttttaggtagaatattgtagtgaatatccttgttatatttttcatctttgttaaaaccccaattggtatctacatcttttgtatcttgatgtacttgtgctgtatttctagccatggacttgttgagtctaaaggatatatgcatttaaagtttttaatttttgccacaataccattttctttattttacatttcctgaatgcttggaagggttgtgcacgttttcatgtgtttgctggtcatttgtactactgtgaattgcctactctggttcttagtccatttttcttagtagattgtcttttcttgtctgtttttcttagtagattgtcttttctaatttgtaaagctcctatgtatcctaaactttaattccttgtttgtttatacaccagagatgttttctttctgttacttaactatagggtggtggttttttttttagaaggagttttacacttgttgcccaggctgaagtgcagtggcacgatctcgactcactgcaacctctgcctcgtgggttcaagcaattctcctgcctcagcctccagagtagctgggattacaggcatgtgccaccatgcctggctaattttgtatttttagtagagacgaggtttctccacgttggccaggctggtcttgaactcctgacctcaagtcacacgcctgcctcggcctcccaatgtgctaggattacaggcatgagccacggtgcctggccccagatgtctctcttaatgagtggctgagctgtatgttttttttactctcagagacatggctttcccttatccagaggcagtgtcactggtagggaggatctcgattatttagtctttgtaactgccctgctgttttagataggtagggcagggctgggcacagtgactcacatctgtaatcccagcactttgggaaactgaggtgggcagatcgcgtgagcccaggaagttggagatcagcctgggtgacatggtgaaactctgtctctactaaaaccacaaaaattagctgggcatagtgtcatgcacctgtagtcccagctacttggaaagctgaggcaggaggatcacttcaccctgggaggcagaggttgccttgagctctggtcatgccactgcactccagcctcagcctgggtgacagactgaaaccctgttccaaaaaaggaagaaactgaggagggaggtggggtaacatagctagtaattaggacagctgggatttgaatctttttttcctccttccagatccattggaacaagcattatttttgataatactcccatgaccatccactaacttcttatacttcctaaaagtgatgttgtatactagctttgtatggttctttcattgacaccattaaacctaagtttaaaaatgaagcatgtcattccctctcccaccatttaaaaatttttttttatttgatgctgagtttctctctgttgcccaggctggagtgcagtcgcacgatcttggctcactgcaacctctgcctcccgggttcaagcgatttctggctaatttttgtattttcagtagagatgggctttcatcatgttggccaggctggtctcgaactccagacctcaagtgatccacctgcctcggcctcccaaagtgctaggattacaggcgtgagccactgtggctgacttctcccacccctccctttttgttcccagttctcattggtctacagtgtgagtcccaagctggaatttggaagaagcttggggctattggacataatgataataaaatagttaattgattaactataattaacatgaataatgaaatccaccattatatagcgctatctgtctggaacagtcgtgtggttggttccttttagctcttggattaaatgttgtatcttaggagagcccttcccagacctgaaattactttcttctccctcttcttcccccttatctatatcaccttatttatttatttttgagatagggtcttgctctgtctcccaggctggagtgcagtggtgccatttcagctcaccgcaccctcaacctcctgggctcaagcgatcctttcacctcagcctccagaatagctgggaccacaggcacgtgctaccatgcccagctaatttttgtattttttgcagagacaggttttgccgtgtgcccaggctggtcttgaaatcctgagctcatgcagttaacccaccttggccacccacagtgttgagattacaggcatgagccactgcgcctagccctaatgtgctttttaaagagtaagcatagctgggtagagtggcgtgtacctgtagtcctgagtacttgggagactgaggcaggaagattgcttgagcccaggagttggaagccagcctgggcaacatagcaagactgtcaaaaaagaaaaagaagaaatttaaaaaagtactattagtactaacagtttacatggtatagtactatgtatgtatgtatgtatgtatgtatgtatgtatgtatgtatgtatgtattttgagacggagtcttgctctgtcaccaggctggagtgcagtgatgtgatcttagctcactgcaacctctgcctcctgggttcaagcgattctcctgcctcagcctcccgagtagctgggactacaggtgtgcaccaccacacccagctaatttttgtatttttagtagagatggagtttcgccatgttggtcaggatggtcttgatctcttgaccttgtgatccccccgcctcggcctcccaaagtgctaggattacaggtgtgagccactgcactcggttgtactttgttttgtttgatgtaacataaaatatttgagtacttttctttctttcttttttttttttaaagagctaggatgttatactattggcccaggctagagtgcagtgcagtggtgcaatcacagctcactcaacctcgaactcctgggctcaagtgatcctctcacctcaacctcccaagtagttgggagtaaaggttcatgtcatcacacctggctaattcttttctttcttttttgagactgagtttcattgttgttgcccagactggagtgcagtggcatgatcttggctcactgcaacctctgcctcctgggttcaagtgattctcttgcctcagcctcacaagtagctgggattacaggtacatgctaccgtgcccggccaatattttgtatttttagtagagacggggtttcaccatgttggccaggctggtctccaactcctgacctcaggtgatccacccaccttggcctcccaaagtgctgggattacaggtgtgagccaccgtgccaggccaattattttactttctttttgtagagatggggtctttctgtgttgcccaggctggtcttgaactcctgtcctcaagtgttcctccagcctcacaaaggattgggattacagtcatgagccaccatacctggtggcttttaagtcttttgttaaaaacaactctggcagagcaagaagacatacaggccactattttgtttgcttttgttttatagtcagtatttcctttcaagttctatttttggcacagaagctgcattggtcctggaagaagaccaggcaacaagctgctgtggctccagttgagtttactttccttgacaagtgaggaatgcattgggtacttgaataaaaccagggaggaatgatggcacttccgttgtgccagaccgtggcaagaagctaggcagctactgtaagtctgtactttttttctgttatctttggaatagttcacatggtagaagaaaaaaaaatacaggcatacctcagaccattgtgataaaatgaatattgtgataaaatgagtcactaattttttggtttcccagtagataaaaagttatgtttacactccattctgttaagtgtgcagtagcattatgtctaaagaaacaatgtatataccttaattaaaaaaatactttattgtggcctggtgggtagctccatcccagcacttggggaagctaaggcaggtggatccctttagctccatgagaccagcgtgggcaacatggcaagattccatctctaccaaaacgatgtaagaattaaccaggcgtggtggtggtgtgtgccggtaatcccagccatttgggaggctgaggtgggaggatcacttgaacctgggaggcagaagctgcagtgagccaatattgtgccaccacactccagcttcggtgacagagccagactctgtctcaaaaaaaaaaaaattattgctaaaaaatgctgattgatcatcttaacatttagtaagctgtaaatcttgctgggtgaaggtcttgcctcagtattgatggatgctgactgatcagggtggtggttaatgaaggctggggtggctgggacaaattaaaacagttttttttttttttgaggcagagttttgctctgttgcccaggctggagtgcagggtgtgatcacagctaactataacctctgccttccgggttcaagcagttcttctgccacagcctctcatgctgaggcaggaggatcacttgagcccaggagttcaagaccaggatcacttgagcccacgagtttgagaccaagctgggcaacatagcaagaccccatctctataaaatattacaaaaattagctgggcatggtggcatgcgcctgtagtcccagctactcgggaggctgaggtgggaggactgcttgggcctgggaggcagatgttgcagtgagccaagattgtgcctctgcactccagcctgggcaacagagccagaccctatctccccaccccataccgtcccccaataaaaaataaataattttgtttttttaaaggctggatgcggtggctcatgcctgtaatcccagcacttggggaggctgaggtgggtgaatcacctgaggtcaggaatttgagaccagcctggctaacatggtgaaaccctgcctgtctctattaaaaatacaaaaatgagccagacatggtggaggcgcctgtaatcccagctacttgggaggctgaggcacaagaattgcttgaactcgggaggcggaggttgtagcgagctgagattgtgccactgcactccagcctgggtgacggagagaccctgtctcaacaacagcaacaacaaaagtcaatcctctcaaaaccctgctgctcatggctgggcgcagtggctcacgcctgtaatctcagcactttgggaggccgaggagggcggatcacaaggtcaggagatcaagaccatcctggctaacacggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacgccactgcgctccagcctggttgacagagtgagactccgtctcaaaaaaaacaacaaaaaaaaaaccctgcggctcctttaagaactatgtttatgtgatattctaagtctttttttatgatttcgacaatgttcacagaatcttcactggggtagatgccatctcatgaaaccactttatttggtcatctataagaagcaactccttaaggctgggtgtggtggctcacacctgtaatcccagcaggcggattgcttgagcccaggactttgagactagcctgggcaacatggtgaaaccccatctctacaaaaaatacaaaaattagccaggtgtggtggcacatgcctgtagtcccagctcctcaggaagctgaggcaggaggattgcttgagcgtgggtggttgaggcctcagtgagctgtggtacgccactgcatttcagcctaggtaacagagtaagaccctgtctccaaaaaagcagggagcaactcctcaaactcctcatctgttgaagtttcatcgtgaggttacagtaattcagtcacatcttcagattccatgtcttttcctatttccaccacacttccagttacttcctccactgaaatcctgaacccttcaaagtcatccattagagttggaatcaacgtctttcagactcctatttgtgttgatattttgacctcctcccgtgaatcagaaatgttcttaatggcatctagaatggtaaatctttaccagaaagattcactttgcccatatccatcacagaaatcattatctatggcagctgtaactttatgaaatatgtcttaaatagtaatacttgaaagttaaaattgctccataatccatgggatgcagaacagatgttgtgttaatgggcgtgaaaacaacattaatctctttgtaccttgctatcagagctcttgggtgaccacgtgcaccgttaatgagcagtaatatatatacacacacacacacacacacacacacacacaagtatatacatatatgtgtgtgtgtgtgtgtgtatatacattttttttttcccatacagagtcttgctctgtcatccaggttggagtgcggtggcatgatctcagctcactgcaacctctgcctcccaggttcaagcaattctcctacctcagtctcccaagtagctgggattacaggtgtgtgccaccacgcctggctaatttttgtatttttagtagagacagggtttcaccatgttggctaggcaggtctagaactcctgacctcaggtgatccactcacttcagcctcccaaagtacggggattacaggtatgagccaccgtgcccggctaattttcttttctttctttttttttttttttgagacagattctcgctctgttgcccaggctggagtgcagttgcgtgatcttggctcactgcaaccttcacctcctgtgttcaagcgattcttgtgcttcagcctccagagtagctgggactactggcacacaccaccacacccggctaatttttgtgtttttattagagatgaggtttcactatgttgcccaggctggtctcgaactcctggcctcaagcaatccacctgccagcagtaatattttgaatttttttttggtgagcagtaggtctcaacagtggacctaaaatattcagtaaatcatgctgtaaacagatgtcattcaggctttattgttccatttataatgcacaggcagaatagattcagtgtaattctttttttctttttttttgagacagggtctgcctctgtcacccaggctgcagtctgcaggctgcagtgctgtggtgcaatctcagcttaatgcaacctctgcctccaggctcaagcaatcccttccacctcagcctcctgagtagctgggactacaggcacatgccaccatgctcgactaatttttttgttctttatggagacagggtttcaccatgttgcccaggctggtctctaattcctggactcaagtgatctgcctgccttggcctcccaaagtgttgggattgcaggtgtgagccactacacctggccctttcatttttatgttatgtagatgggttctttccttaaacctcatgaagcaacctcttctaacttttcttcagcttcctcaactgtctcagccctcatagaattgaagagagttatggtcttgctttggcttatggaatattgtggttggtttgatctttccagtccatgaaaacattcttcttaccagcaataaggctgtttcactttcttgttattcctgtgtttattggagtagcacttttaatttccttttaataactttctctgaggctgaggtagggggatcgcttgaacagccagcagttcaaggctgcagtgagatgtgattgcaccactgcaccccagtctgggccatatgaacgagacccagtatctagtaaaagaaaaaaaaacagtacttgtctcttcgcattcacaacttggctgtttggtgcaagagtcctagctttcagcctcagctttttgacatgccttcctcactaagcttaatcatttctagccccccccacctgccttttttttttatgagacagtctcactctgttgcccaggctggagtgcagtggaacaatctcagctcactgcgacttccacctcccgggttcaagtgattctcctgccttagcccaccaagtagctgggattgtaggtgtgcgccaccagacccagcaaatttttatatttttggtagagatggggtttcaccatgtttgtcaggctgctcttgggctcctgacttcaagtcatctgcccggctcagcctcccaaagtgctggaattacaggggtgcgccaccatgcctggcccatttctagcttttgacttaaagtgagagatgtgcatttcttccttttacttacttgaacacttagagaccactatagggttattatttggacttatttcaatattgctgtgtctcagggaataaggaggcctgaagagaagggagagagatggggaatagctattggagcagtgagaatatacacagcatttactgattaagtttaccatcttatatgagcacagtgcatggtgccccaaaacaattaacaatagtaacattgaagaacactgatcgcaggctgggcatggtggttcacacctgtaatcctagcactttaggaggctgaggtgggtagatcacctgagatcaggaattcaagaccagcctgaccaacatggtgaaaccctgtctctactacaaaaattagccaggtctgctggcaggcgcctataaccccagctactcagtaggctgaggcaggagaattgcttgaacccgggaggcggaggttgcagtgagccgagagctgagatcctgccactgcattccagcctgggtgacagggcaagactattgtctccaaaaaacaaacaaacaaacaaaaaaacactgattacacatcaccataagagataaaataataatgaaaaagcttcttgagataataggagcatcaccaaaatgtaagggaggcatacaaagtgagcaaatgctgttggaaaattggcaccagtagacttacctgaagcagggctgccacaaacctcaatttgtaaaaagcgcaatatctgtaaagcacaataaaatgaggtatgcctgtagggccaggaaaaattgaggaaaaattcattcctcttcactgccccacaggtgtcttggggagagggagtatgaaaaactaatttaattttaccctttgtctttcaggtttgtcctatttcaaaggcacgtgatgggatctttttgaagtgcctttcttagccacacctagggattaggttctctgaattcagggacttctcacagtatgtttttacttggttgccttccttttcctaaaatgatttaagaagtcctttgcacatacagaatgctccgtggccattaaataacaacccttttcctgccagtcattgacctccaaaaattcaaggggtcagtttgtttgaacttgagatctaacaccatttgttcagtttttttgttgaaattactgaatcaaacttcagaaaaagggtggggagcacaacagagtgacaaaattatgctattaagttgtgtagaaaatagaaaacacttttgaacatatagacaagataaaaaggccacgttttgcgttcgtcatacaaccgctaaaaatacagcagtgccttgctgctgctctgtctctgtggaatatcatggttaaagtataacccccatttggtgcataggaaaaaggcacacaaaattaatttaatttttctaagattacatatataaaattacaaggaacgtgtagatttcctgactatacctggtattttatcaatgaattgaaatgtgtaaagaacctcagagtacaacagagtaattactatggtttcctagcatgcattgtaactacttaatacattattaattattcagggaggtggttttttctagttgctactatgtatattttgattttttttttttttagcacagaggcatagtaatatttgtattaatgttggtgaaatgaaaatttaaaattttatgtaaaatgaaaatttaaattgaatttcagaacaaaactttatcaaatattttccaaaataggcttttgtgttttaagtttctaccttaattaacttttaggccacccttggtttttgaaatttgaatctgattctgttttcttcaagggcctgtatcttcctttgtatacgctttgcatagcaagtacaggtcatgcttagcattgtgttgaatgttgagtttatttcagtgtaaactgaatgctttagcgtaaactcagcattcaacacaatgtctggcattaaatgatttgcatagtattatgtaaaatgttcttgtacattgtagcagtgaggatatctgatataattttgacatcagcattatatatgtaattacatttctatttttaagtattaaggaatggaaatattttaatcttaatatacttaggaactctgggatcttccccaacctccccacttcccccaatagctgctgctggagatggaatcctatctgagggttaataataatgccatcacccattcccttcccccagccttatgctagagcctagtttgcctgcagctgcagtgctaggcatctttcaggaagtgaccttggcttgtattaatcaaattcagaacacacaaaaaagcttcttgctaacatgctgacttgatgtaaaattttatcgcatccattttgtttcaaaatgaggccattttgtaaaaagaagatatacagaagacccctaatttattatatatctatatatacgtatatgtaaagcttttgcaaaccatgttgaaaaaacaactaggtctattttaaagtagactttttattgccaaatatgcataaacttaaatcatgaaggcttgggaattgttactagaaaattacttcttttaatgtcgaattaagaaaaaactatcagcatcgagtttatttactatcttaactgacattatattgctatataaactttaaacactgaagttattttggaacccttcagcagttatattaagtcacacacttctgtatatttgcttactttcacgttttcagaaataactggtatcttactttgctggtttggataagagctaatatcctacatgaaatcgttttcttaggcaatggtggtgcctacagggtattctaaacgtaaaggtaaatttaagtcaatgagtctgttaaaattcaactacctattgtgtcaaagagagaaatattgctaactacaaatttacagtgtgttcatttaggatttgactaatcattttaatagtagagcagttaatacagcgatttcacttttatcctgtggtgcttcaaaggcatctagtttttaaatgtagtccagttaaggtgtatgtagtagaggttttcattttagacttgctcaatgttaaatatagaatgttgaaaatattatttaatggattagtttattggtttctgcatttgaagaaatttacataaattagttagggagcagttgtacctactgccaaatggttcactcctgagtttattgtacagttactcccaggtactgaaatataagaaaagaaaaatttaaaccttagctaagagctctgcctgcatttctgtggatccacattatgaaaaggatagaggaacattacctgtgtatagtaatggtttgaggagagggtagggaaactatgcaaataaaaaaattggggtataggcaaatccttcagttagatgtctttattatctgagttacttttaaagcatttactggatacacaaccagtattatctttttaccatcctataaattgttcatagaattgcaacctcatggaggaaaatccatctcctttacctgcctaaatttattctttgtcttgatactagcattaataattggtttgttagatactacaggctaaagaaactcagatttcaagaagaaagaagataattactcgatcatttctcccctcaaacacctgtttaaaatatattgtcttgaataaaattgtcaccttgaacttattgtgttctttgccttctccactcccctgtccttaaaaaaaataaaaagaagggaaagccttataagaaaaggaaaatgtgcaatcctggtagccaatgagttaatgttcatttgcagcccgaggggtcagcatgcagcctgtgtttcctgattggctgctaaaaggtgaaattgaaaccactgtaaacttttgaccctgtagcaattcttgtggaacgccttccactggtggagcccagagctttgctcacttccccacccaactctcccaccctctttcctgtatttattttgtgtgatcctgcagcactgcatgcagtttttccaaagtggcagggagagagaggcagaacaagcgcaagcaagcggcttgcttgaatgcctgttttggtaaccattggataagagctaatattcaactcagccaaagatatcaggccttttatactaatctgccaaccagatttttaagttttctccttaatctaaagctaatttaaaaaaatttaggctagtttagttccattgttcatcagtggatagtatcgttgtataagcaaaaatgtatggcataatttcctggatgtcttgaattaaaaataagttttaagttttagctacctttaccccatttatgtttcctgtatccctatgtaatttttacacaaatggccatttcatagaaggttttttgtcttttgcctttattatgaagaaactcaaatggcattttggttatgacaactctggacataattgcagaaattgtacaattaatgcctccccctttggctgagataaatggttttggatttgtcttgctttcacatgtaaatagtgttgaacagttaacaaccccatgaaaaaggcagggtagtttttctctattctttccttatactctcatgggactctggtctttttaattcttccttttatccatggtgtctagcacaatgtggcacatggatgcttagcagatgcttactgaatgaacatagctttcattttaggaactttaggtctgtttatacctgcttcccttttcctaattaattgatggcagcaactgtgatttgcttatttccaagtgccagtgcagtgcctgattctaatagatacacagcaagcatttaattgaaatcgaattaaaatctaacacaagatcatttcaagaagcaggactttacaaaatctaggttttcagaagccaaggcgtctgttttcactgcgttattatgaattttcaggctgattccgtatagaactaaatgtttaatttattaaatatgtagaatacattataagtcagcttgattctttctagtatatatcacaagatatgtggtaatacctgtctttattttactagacatgcatatgctgtaatttgaaataattccttgtcccccactcccttatcaagaagattatagcatttaaaaaagattgttataaatgtcttaccaatgttctcctgggaagcaaatacatttttacttaattgaacatacaataatggactaagtaatgggaaaaaaaaattcttaaactgagttaagtttatatagctcaaaaaaagtggtaccattttatataactttattattattattttttaagacagagtcttgctctgttgcccaggctggagtgcagtggcgcgatctcagctcactgcaacctctgcctacggggttcaagcgattctcctgcctcggcctcccgagtagctggaactacaggcgcccaccaccacacccagctactttttgtatttttagtagagatggggtttagccatgttggccaggctggtctcgaactcctgacctcaggtgatctgcccacctcggcctcccaaaatgctaggattacaggcatgagccactgcacccagccccattttatataacttgaaatgttcatatgattttcaacttgcatttggtcttctcctttcattatagctacagattagctgtagttgattgttgcaagtgaaacctgtggttagagttttgatcaaagatacttatcacttgataaataatcccaactgcaaaagtgttggattttgacgttaaatttaacactaatattttgcagcctttaacctgaaattcatttggtgacccagtctactctgtagtactttgaagattattgagcaacagctagcttttcccagtgacagtggctccccttttctgtgattttagggaagtgaggaaggagatcctgggagcagtgccagtgggagcttggaaagaacaatgggtttaatatgattaattgtagaatccttgccccttttcatgttcaacagtaaaagaaaaacatgtttataatattcagtggctgctttttgccctgttggtgtttccaagcattatatattatatagtttggattttcctgtgtatcaactcctctccccaattttattctttgttctggctttgaggcatatcttctcagactagctattaacaaggcttaatttgatgtttgatttcccctcacgtccttttaggtctctggtgatgaaggcttaaaataaaaacctaaaactaaaacaggggccatgttgtccaagatggactcagattcctgagctcaagcaatcttcctgcctcagcctcctgagtagctggcgttacaggtgtgcgctgccatgcctggcctggtgatgcaggttttggtaatgtagatgtcatcagtaaaccattaattctactagaaaatttaatgtccctgttaccttctcagatgtctaatgtttctggaacttctcacatttagttttatgtcagtatgatttggtttttgtatgtgtgattgatgaaaatctgaattgtgaaaagggataatcttgtttttgataaagaaaaaaaatactgtcctaagaaatctgctaggattgttgcctttgcagaatcttttttccagacaagtttaactcaccagcaaatttactaacagttctatacttacaggatcctggtatatagtagtactcctttccaggttcctggtaggcaagccaatcattgttctgtgactatttgcgaatctctctggtttaattatacacttccttggaggggagaattttgtacctggcttgtctttgtgttactgaactgaactgggtctatttttctgtgtatgcaatggaaagctgaacactaagcaccaagtttttgtaggaagaaaagtttattgcaaggctgctgtgtaaggagacaggagttgggctcaaatctgcctctctgaactagagtttgggtgcaggttttatatttggagagtaatgaggtgtgatctgagtggatcctgccatgggatgatgtcaaggcttgatttggttgcatcttctgtcctgccatgtggtgtctgctcttattcattcgctgttcctcagtttgatcatttagattccacccatggttgcattctttgttcatctgggcatgctgactttacatgatcttccacctgggggtccagcagttaacatttgggtccaagggtgcagattggcagggtcagcattcctttgagaagtacgaagaccagcactataacactggagtattaatctaggccctctcaccaccttctacacgaggcagcagtaattgtttcctaggtccattatgctactagatactttctgactcaaattcctttcctggccgggcacggtggctcatgcctgtaatcccagcactttgggaggccgaggtgggcagatttcttgaggtcaagagttcgataccagcctggccaatgtagtgaaaccctgtctctacaaaaattagctgggcatggtggcatgcacctgtaatcccagctactcgggaggctgaggcaggagaatcgctttaacccgggaggcagaggttgcaatgagccgagatcatgccccactgcactctagcctgtgcaacagagtgaaactccatcccccacccccatccccccaaaaaatcctttccttatcccacctcttttgttccttaggtgctaaccccaccccatgaccctccttcgtctttcctaataaaggaaaaaacataagagaaccattttagaagtcaaacctgatttaaaacagggccagaagatcttagaggttctttacagaagttctgcctaccttttctccgttcatcttacacgaattaaattggatagcataaaaattcaagttaaaaaacataacattcggtccggtatggtggctcacacctgtaatcccaacactttgggaggccgaggcagacagatcacttgagctcaggagttcaaggccagcctgggcaacatggtgaaaccctgtctctacaaaaaatataaaaattagctgggtatgatggtgtgtgcctgtagtcccagctccttgggtagttgatgtgggagtattgtttgagcctcggaggtcgaggctgaggtgagccatgaccataccaccacactccagccagtctgggcacagagtgagatcctgtctcaaaaagaaaaagaaaaaagctacaactttggtgcacaaaattattaaaaatattatataaaattaccttcaggctgtgtgtataagtaacataaatgaattttatgtttggacttgggtttcttcccctagatatctcagtatgcatatgcaaatatttaagaaatctgaaaaaaattcgagacacttatgcttctaagcattttgcataagggatagtcacccggcactacctagagttttctttttcctttgttgtgagccacatgtaatgtgcctcccattccctgctcactgattttctcccctctaattttagtttcagaaacacaacagacctttccataatgcagctagattgtggttggctctccctatatactgtctgcagactacactacgtggaatgtccatggctataatatgtttgttacttgtaacttgtgaatatatcatttttcctttcccccataccaacagatctaccaattccagcatgaaagctattaactttagggcgtaattatggttgttatcttggttcgataccattggaattagtggcaatcatattgttgctttattgttaaatttggaaattcataaggtaaagtgaatgttcttactggttcacttatttattgcagcagaacctgcacgccatttcttcaagtgcaaaagcctgctgtttatatgttcatgtgttttattgtagattattttgaagaacggtctctcatttccttgctaatattttgttttggtggtcaaaatgcatccttttatagaaggcaagaaaacatctgagcctttcctctggcctttgcttgttggctttatccatccctccctcatctgataatttttggactagggcatttaagcatttgattctgccagggtattaatgttgtctttattctctgttgagcactgattttggacaaatgaatacccccacaagttcagagtacccatctgttttgatcacttttcaagattcagaactggtctccaccacctccactttgcattatccatttttacaaactgtgacagagtacatattatatatgctatgcctgacttttattttaattaattaattaattaatttacttatttttgagatggagttttgcttttgttgcccaggctagagcgcaatggcatggtcttgggtcactgtaacctctgcttccctaattcaggtgattctcctgcctcagcctcctgagtagctggactacaggcgcatgccatcacaccaaactaattttttgtatttttagtagatatggggtttcaccatgttgaccaggctggtctcaaactcctgacctcatgtgatccacccacctcggcctcccaaagtgctgggattcgaggcatgagccactgcgcctggccctgacttttgttttttaatttttatttttttgtgtgtggagatggtgtcttgctatgttgctcaggctgatcttgaactcctggcctcaagcggtcctcctacctcagcctttcaaagttctgggattataggcatgagccactgcgcctggccctatgcttgacttttcaaacagaagtagtgattatatggtacaataagacatctactcaaattcctaggaagaggtggtgtacttgatagcttttgtttgtttcatatatccagggaagggaaaaatgggaagacttaatttttttgagagagaatctcgctctgtcaccctggctggagtgcagtggcatagtctcgggtcactgcaacctctgcctcccaggttcaagtgattctcctgcttcaacctcctgagtagttgggattacaggcggatgccatgtcgcccggctaatttctgtatttttagtagagttggggttttgccatgttggccaggccagccttgaactcctgacctcaagtgatttgcccgccttgcctcccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccaggtaattcagctttagtttgatttgatcctttgtaattttttgtcttcaaccttctgaagatattaccctcctctttaatttatgatttaattaaaactatttatgcttcatgtttttctctttaatgattattaaatgaatgtgcttagagtacttgagtgaatacgtatgtgtatgtacagttggcccttgaacaactgaggactggggacactgaccccttgttcagtaaaaaatgtgcagaactttcgactccccccaaacttaactactaataacctcctcttgcctagaagcctcactgttaatataaacagctgattaacacatattttgtatgttacatatattatatcctgtattcttacaataaagtaagctagagaaaataaaatgttattaagaaaattatggccaagtgcagtgactcatgtttataatcctagcactttgagaggctgaggtggttagatcacctgagtccaggagtttgagaacagtctgggcaacagagcgaaaccccatctctacagagaatgcaaaaactagccagacatagtggcctgtgccttagtccctagcactagagacactgaggtgggaggattgcctgtgcccatgaggttgaggctgcgcctcagctgtgattgtgccactgcactctagcctgggcaacagaatgaaaccctgtctccaaaaagaaaaaaaagaaatagaaaaaaggagaaaattttaaggaggctggacatggtggctcactcatatgctcacaactatgatcctagcactttggggattggaggtgggaggatcacttgaggccaggagttggagaccagcctaaacaacacagtaacacccccagttctacaaaacacacaaaaaattagctagcaaggtggtgtgcgcttgtagtcctagctgcttgggaggctgaggtgggagattgcttgatctcaggagtttgaagctgcagtgagctatgactgcaccactacacttcagcatgggcaacagtatgaaaccttgtctctagaaaataagtaaataaataaataattaaaaaggaaagacatggccggatgcggtggcgcatgcctgtaatcccagcactttgggaggccaaggtgggtggatcacctgaggttaggagtttgagaccagcctggccaatgtggtgaagctccgtctctactaaaaatacaaaaattagccgggcatagtggcgtgtgcctgtaatcccagctactcgaaaagctgaggcaggaaaatcacttgaaccttggaggtggaggttgtagtgagctgagatcatgctacagcactccagcctgggcaacagagtgagacttcatctcaaaaaaaaaaaaaaaagtcataaggaagagaaaatatacatattattcattaagtggatcatcataaaggtcttcattcttttcgtgaggttgagtaggcttgaggaggagaaagaagaggaaatgttggtcctactgtcttaggcatggcagaaatagagaaaaatctgcgtataacagaacaaatgcagttcaaatgtgttgtacaaggggttatggtattcgtatatatgtatatacatacaaatacaaacataattttgggggaagagaagaaattccccctccttatgtgtgaatattttaatggcatttagtcaaacatctgaattagcctaacttacatttgctgtttcaccttgtgaagacaaatttccccagattgcttgtgctggcaaataacatttcatctaacccctttcttaactttttttttttttttttttttttttgagacagactccctctgtcacccaggctggagtgcagtggtgtgatctcggcttactgcagcttctgcctcctggattcaagcaattctcatgcctcagcctcccaagtagctgggattacaggcgtgcacggccacatccggctaagttttgtatttttggtagagatgggatttcaccatgttggccaggctgaaactcctggcctcaagtgacgtgcctgccttggcctaaagtgctgggattataggcgtgagccactacgcctggccccttttcttaacttttaatattacatcagaataggaaaaatgagaatagaaaaagctgtctagttgccgagaaaacaatcatgctttgcttagctaaatttcttttggtaatcccatcattctcttggttagctaggtttgaaatctgagttgtctttgaatcccaccgtactctgattcatttggtaagcaggctttatctggctttctattttcatgtgtcctgtatttgttccactttctgttcctaattttagcttccgaggccaagaccccataatttcatgagggtgtttttccttgtctctactgcttccttgtccactcacttaaaatttagctagattttcctaaatgtatacttttagccaagcttatgttgtgctctaagttttgtgctacctttccttggcttacagaaagaaaaagtacaaactcccttctctgacatttcaaatggtactttatctgagaatctatccaagttaccagccttaggtcttgcaatttccctgtaaaatccctcagttaattgtgatatatacccattcttctgaacatggcagagaactatctccacaggttttttttttttttttttgagacagagtttgttacccagcttggagtgcaatggcgcgatcttgtttcactgcaacctccacttccagggtcaagtgattctcctgcctcagcctcctgagtagctgggattacaggcacgcgccaccctgcccggctaattttgtatttttagtagagacggggtttcaccatgttggccaggctggtcttgaactcctgaccttaggtgatctacctgcctcggcctcccaaagtgctggggttacaggtgtgaaccactgtgctcggccaattttttcttttttaaataccttttatttggaagtatacatttacaaaagttacaaaaatatagtataaagaacatctggatatccgttatccagacttacccacttgcttatttgtatttgtgctgtcctactctcttttctctttttctacccacgtaaacacacacacaatttttttttttaaccatttgagggtgagttacatatgttatgcttctttcccctaatacttctgttgtattcctacagatagggtcattctcttatataaccatggtacagttaataacttcataaatggacatcgatgaaatctatcgcccatattccagttttgtcagttgacctaagaaagtctcttgtagcattttctatgcttcctgtatagactacagtctggggtcaggttctgcattcagttattatttctctttggcctcctttttcctgggatattttcacagcctgtctttatctcttatgacattggcatttttgagaacacaacccttccctaacccctttactctgttcagtggagatgttcttcattttatgttggtctgaaatttccttgtgattagattaagatgttatggattcttggcaggaatactgcatccgcaatgtgatactctgagatggagtcatatgacgtccgtctgtcccttattgtgatgcaaattttgatcccttggccaaggtgttgccagatttctccaccatttggtttttttgccctctcttttgccaagcaataagcagcttgtggggaaacaatgcagatattctgattcttttcacggtttcttctagatttagcatccattgactcttgtctgatccagctttttattgtgatgattgcaaaatggtcatttttttctttccagcattcctttcccattacccgtcggatcttggctgtattccataatcaatagccctatgtattggtgatggattcatgaattcctattttttgaatggtttacaattcacttaccctgcttaattattttagtgctcaaattgtcctagaagtttggctagtgaaactcctgtaagtgggccgctgtgtccttgtggggaataaaagttttagagaccaagatctctctgagtgctaggtgtcctcactacttctgggctgttttctcatcttggcctttttagtggatagagctaggaaataatatgcatgcttatacacatacatgtacatatacatactcatacagtcatcccttcgtacctgagggtgattgggtctaagaccctttgtgtgcaccaaaatctgctgatgcttaagttctttaaactataaagtagcaattgtatttgcatataacccatgttcaatttcttgtatgctttaagtcatctctagattacttataagaatctaacacagtgtaaatactgtgtaggttgttgttaaactgtattttttaatttgtattttattgctgtattgtttttttaaatttattttttgagtatttttgatccatggatgcagaatccacgatacagagggccgacttcgcatgtgttcattgaaacatacatatacatattttagaaatcatgagcttatatcagtatgtacgtctttattccatgtctacagggttctttgtacttcattttttatttttatgtcccttattattatgtgggaatcctgactctcaaccttagtacatttactcatttgcctaatcctctaatacatctaaaataatttcagaattggttttttcatttcactgcaataaacaaactgaaaatgagtggagcatttgtctataattcttctccacctcccaattttacccaagaccgagagtaaacagttaaaatttaaattgcttggattagccctccataccctttctccaccccactttttttttttttttttttttttttttgaggcagtcttggttgctcaggctggagtgcagtggtgcgaccttggctcactgcaacctctgccttctgggttcatgggattcttctgcctcagcctcctgagtagctgcaactacaggtgcgtgccaccatgcccagctaatttttgtatctttaatagagacagggtctcaccacgttgcccaagctggtctccaactcctgaggtcaggcgatccgcccgcctctgcctcccaaggtgctgggattacaggagtgagccaccacgcccgacctccaccccacttttacttcccaccttactttctgtataaactagttagggtattcatttgaaacaaaattaagtttatttacttgtttgcttatgctgcctcccattctgatttttatttttgtaatatgtagaataataacatgctttcaaaagtcaaaattatacaaaaggcatacattgcttttgtatcccttccatgccatttttcttcagttttcttaggtaaccaacttaaatgttttctgtcttatccttcccatttcttttttttgatggtatctgtatgttttatttatttatttatacaaaagatagcgtactatatatactcttgcactttgctttttttcctacttaactgatatctcctggaaataatgccctatcatgccaaagagatctttcccattcatttattttaattgtagtaaaatttacagaatataaaatacaacttttttttcttttaaagactgaatttggctcttgtctctcaggctggagtacagtggtgcaatctcagctcactgcaacctctgcctcccaggttcaagagattctcctgcctcagcctcccaagtatctgggactacaaatgcccaacagcatgcccgtctaatttttgtatttttttttagtagagacaggttttcaccatgttgaccaggctggtttcaaactcctgacctcaggtgatccacccgcctcagcttcccaaagtgcttgggagtaagctacaggtgtaagccattgtgcccggccagaggaccaacttttgattaaattatagatatccagttccagggctatttgtagaaaagatgttccttttttcttggtttgctttggtaacttgattaattgattatatttgccaaagtctctttctggcctctattcagtgccatcctcatgcccatatacattgtctgattataggactttatttatttttttgagatagagtctcgctctgtcactcaggctgacgtgcagtggcgcaccctcagctcactgcaacctctgcctccctggttcaagtgattctcctgccccagcctcctgagtagctgggattacaggtgcccactactaagcccagctaattttttttttttaagtagtgacggggttttgccatgttgtccaggttgatctcgagctcctgactcaggtgatacaccctccttgacctcccaaagttctgggattataggcatgagccactgcacctggctgacttgaacttttaaagtctcttttatttgttcttttatcctgaaactaggaaacaaatacaataccctctccaccagatttcacttggaatacttataaatttggatgaagtcatctcttgttcaggttccctaaatttactgagtcattggctgccactaagtgaccttccatctgtgaagctagtccctgtaaaccaagaacaggtaccaggcccataaacattgacttcttgtataatgtaaaatctttgttttctttttaaaaaaattttttaatttataagatgtttatttaaaatgttttgtggaagtgaggtatcactatattgcctaggctagtcttgaactcctgggctcaaataatccccctgcattggtttccccaagtgttggtgctgggattacaggtgtgagccactgtgtcctgccctactatctttgttatagtggtggacttgtcatacgattatattataattatatgacattatatcattatattgttcttaattataagaaatagtatatgacctagattgtacaatgatttgtccagttatcctggtaaattttatttacctttgtcttgacggaatttgattaagcctatgcaaataacgttattaacatgaaaaaatagacttagtttttactttattttgaggtggggtctcactctcttgacctacctggagtgcagtggtatgattgtggctcattgcaatcttgaattcctggactcaagcagtcctgcctcagcctcctgagtagctgggactacaggcatgcgccaccgctctcaaatgccatttaaaaattttcctacaaaagcataatatattaaattgtgagctagaggtagatgaagaagaaaggaaaagggcttcctcatatagccatcagaaaacagaatattaaaaaataacaccagcctgggcaatatggtaagaccccgtctctacaaaaataaaaaataaaaacattaactgggcattgtgtgtcacatgcctgtggtcccagctgctggggaggctgaggtaggaggatcgcttgacgctgggaggctgatgcctcagtgagccgtgatcgcaccatcgcaccccatcctgggcaagagaccaagaccctgcctcaaaacaaaacaaaaaacggctgggcatggtggctcatacctgtagtcccagcactttgggaggctgaggcaggttgatcacctgaggtcaggagttcaagaccagcctgaccaacgtggtgaaacctctctctactaaaaacgtaaaaattagctgggggtggtgatgggtgcctgtaatcccagctactcgggaggctgaggcataagaatcacttgaaccccagggggcagaggctgcagtgagccgagatcgcaccattgcattccagcctgggaaacagagtaagattgtgtctcaagacaaaaaacaaaagacaaaagaaaaaacaaaagaaaaaaccatagtctgaaacaactggttaaatttctgccactagttcatttagtcctatgcagttaattctgtttctcttaggcttattctgtagtcacttttaagttgtctgcttagatgtttaagatacctagacattttggcctttagtatagttttaaaatttaaaaatgttagctcagtagttcattgcccagagtatttcataaattatcaagatttaaaggtactttgtacagtcttttgcatgagaatcttcaactgtcctttgaagacaaattatagcatatgagtcctcaagggaagcatcggagagtagcagaagccatcacccatttgacagtaagacatttctggtactcttcattcatctttatagatgtgcattttcatctgatgcccctttctctttggcctgaaggatataatttcatttccagaattgtttatcactgattgtctcaacttttatttatctgaaaatgtctttatttcaccctatttttgaaggtttggttcactggatagaaaattctgggttgttgatttttttatttcagcactttaaagttgttctgtggtgttgtaacctcctcccctttttttttttgaagagttgatttttaatcttgttctcagtatgtgtggtctttttttcttgtggatacttttaagattttctttttacgtttggtttaaaatagtttgactatgtatttaggtctagttttctttgtatttatcctgcatggtattctttgagcttcttggatttgtaaatttgtgttttcatcaaatatggaaagttttggccattcttcaagtactttttctgcatctctgcttcaatttaattctccttcctctgggactccaatcatacttgctaggccatttgattttcttttgttttgaggtggagtttcgttcttgtaccccaggctggagtgcagtggtgctcttttggctcactgcaacctccgcctcctgggttcaagcaattctcctgcctcagctcctgagtagctgggattacaggtgcttgccaccacacctggctaattttttttgtatttttagtagagatggggttttgccatgttggccaggctggtcttgaactcctgacctcaggtgatccatctgccccagcctcccaaagtgctgggattacaggtgtgagccaccaggcccagccgaccatttgatatgtttataagtcattaaggttctaaccatttttcttcagtcttcttcctttctcttcttcaaattggataattcttttgatatcccttcaagttcagtgactttttctgccaactcaatttctaagcactattcaacaatgaaatacttttacctcttatttcattcctacagccctgtgttggggttgatagaggcttcagaaaaggtaacaggtttatcaaagttatatacctagtttgtggcagaactgaaattagaacctaacttgattgtttacaaactacagaccattttctttccataatgccatgatctttatcttctaataagttgctgtcagttaaaatgttcatactgtaactggtgtgagtggtggtcctggtagcggatgctacttaattaacaacattgtcaaattgcagaaaattgaagttcttctcatttaaaaaacggttttcagttgaagaatttaagtatcctgaagtcagtaataccttgaactaatctttttagatgacattcctccagcagtgaaagtatgtctgtggttactcaacagaaaaatttaattctaatgacagactgtttttttgagacagagttttgctcttgttgcccaggctggagtgcagtagtgtgatctcctctcactacaatctctgcctcccaggttcaagcgattttcctgcctcagcctctcaagtagctcgggttacaggcatccgccaccacaccctgctaatgttttgtattttgtagagatggagtttcaccatgttggccaggctggtcttgacctcctgacctcaggtgatccacctgcctcggcctcccaaagtgctgggactacaggcctgagccactgcacccggccaccacatacgttttaaaatcaagactttggaatcccagactgcggtatcattcattgtctcggaaattaactctttggagtacctcctcttgagttgatggattttttttttttttttttttttttttttgagacagtctcgctctgttgcccaggctggagtgcagtggtgcgtcgcggctcactgcaagctccacctcccgggttcactccattctcctgcctcagcctccggagtagctgcgactacaggcgcccgccaccacgcccggctaattttttttgtatttttagtagagatggggtttcaccatgttagccaggatggtctcgatctcctgacctcgtgatccgcctgcctcggcctcccaaagcgctaggattacagacgtgagccactgcgcctggccaagttgatggatttaacttcatgaaaatttttaaaccagtttttgtgtcatcttagttaaaataagaacattataaagtttggtaaaggaatgaaagcattactaagccaggataattatcaagtgcctttatataaacattttcctaaaattctagtttctaaagttctgttagaaccttataagataattagtagtatgggaaaagaattactggcataagaatgacattcttagttgtagtaaccgtatatttatatttctccttcagtttattttgaaattaaatttctaaagtttaaaggtaaacattttaattataaattctgcattcatgccttctaattaaaatatgaaccaaattcatagaaatcctataaggcaacgattacttaaaaaccaaacaacttaagtgaattgtttttaggtttgtattgccttatgtataaaaatcaacatttgttgattttgccttggatataacacctctcatatttaaagccagaaaacacatgttgccagatgggaactaggaagagtagtagtctcatcttggcatcattttcttcataatgaccagttcacttgttttacacataatctcaggttctttccagctttaattttctatgattgacggatcagattctacattacggaaccttttagttacctgctaactgctgttacaccactcaagatgcgtgataaccagtcagattagaagatgaaagtcttggccaggtgcagtggctcatgcctgtaatcctagcactttgggaggcctaggtgggcagatcacttgaggtcaggagttcgaaaccagcctggccaacatgatgagatctcgtctctactaaaaatacaaaacaattagcctggcgtgttggcaggcacctgtaatcccagctactcaggaggctgaggcaggagaatcccttgaacctgggaggtggaggttgcagtgagtggagattgtgccactgcactccaggctgggcgacagagcgagactctgtctcaaaaaaaaaaaaaaaaaaaaaaaaaaaaaaagagaagatgaaagtcttcatgatattgctgggcacggtggctcacgcctgtaatcccagcactttggaaggctgaggtgggcagaatacctgatttttttttttttttttttttggagacagttttgctgttgccgcccagtctggagcgcagtaccgcgatctcagctcactgcaacctctgccttccgagttcaagtaattctcctgcctcagcctcctgagtagctgggattacaggcacccgccaccacgactggctaatttttgtatttttagtagagatggaattttgccacgctggccaggctggtctcgatcccctgacctcaggcaatccgcctgcctttgcctcccaaagtgatgggattacaggtgtgagccaccacgcccagcctttaaaatgaccttttttttttttttaaagacactctcactctgtcaccctagttggagtgcagcggcgccatctcggctcactgcaacctctgcctgttgggttcaagcgattctgctgcctcagctccctgagtagctgggactacaggcacgtaccaccatgcccagctaattttttatttttagtagagatggggtttcaccatgttggccaggctggtctcaaacttctgacctcaggtgatccgcccgccttggcctaccaaagtgtgctgggattacaggagtgagccaccacgcctggccttaaaataattttttacaggagatatctatagggataggtcaagaatctacagtccttggctggcgcttaacttgcaaaggaccgtgatttataactggttttaaattttttagactggtgggatcttccacttggtgtggctggaaaagagtgatttattattggaagtccagtaaggccagttctatctaaactgttagaatagctgtaagtgatgtggctttactgagattccatgaaaaaaataaaatatttgatgccatgacataaggctttttttttttttaattttttggtgggattggttaaaagcttggctctgaagttagaatgacttggatttaatttctagctccaccacttactggatgtatgactttgggttgagtttacctttcgatgtctcagtgttttcaagtgaagtagggataatattgaactgtactttcatctagctcactattctgtgtttcatagggctgtcaggaggattaaatgggagtaataagtggaatgcatttatcacaatacctcactcagatgttagagcaagtatttgttcacatagtgattttttactttaaacactaaaattacacattatttttatataaataaagagtatatattatttgaattatgaagtatactttgaaggctattcttgaacccactccttgaactgaagaacgggacggtcagttcgtatagtgtacctgctccctgaatctttcttcccgaagtcatcctgcttctatccttgaagtcacagctatctttgagttaataattaacttcatttaaaaaactttgaaaaagtctcatttggatgtgtccttgaacaatgtttagttttcttgttttttttagctttccaaaaatataatggatgtaatgtggtggctttctaaattgtaagatccaaccatgttgtgtataattcatttttaccatccctgtattgtattcttttgcatggcttcattagaattcatttttcaaatctgcaattgataaacattagagtttcttctagcttttgaagtgtgaacaacgttgcaatgatcattttttgtatctcgtttaaaatatttttattgctctaaagttttaaacaaacttgattttaactgctaatatatttgctttcaatgtggtggtactactttagaaaaagtaaattttctttctttttttaaattttagacagggtctcacactgttgcccaggctgaactgcagtgccatgatcttggcttactgcagcctctgccgcccagtctcaagcgatactcccacctcagcctcttgagtagctgggactacaggcgcttgccaccacacttgactaattaatatttttacatttttggtagagatggggatttcaacatgttgcccagggtggtctcgaactgagctcaagcgatccacctgcctcggcctcctgaagtgctgggattacaggtgtgaggcaccatactaagccaaaagtaaattttcttactgaaatgttttatacattgtttcttgttttattagctaagttatttcatatcactttttatttatcataggattagcaataagcactgtaattttccttaagtacttgatttcaaaaaaccaactttattaaagcataatatacatacaaaatatttaccaaccttacatttacaatttaatgagttttgacaaatgtgaccatcaccacagtcatgatataaaacatttctaccattccctaaagttctttgtgcctctgtgcaatcagtcatctccactggtccctagcaaccagaagaaacctccaactggtctgctttatgtcactactgttttaccttttctaaaatttcatgtgaatagtattcccattttgtgtgtgttacaccttttataattgtcccaccattcttggatattcttttctttttcattttctctttctttttcagttttggggagtttgtattgatcttaaggctctctggtctcccactcctatgtttggtctactgatgagcccatcaaaggcattttgcatttctgttagtcttttttgattctaacctgtgcttttttttttttttttgggagggggagatggagtttcgctctgtcgcctaggctggagtgcagtggtgcgatctcggctaactgtaacctctgcctcccgggttcatgccattctcctgcctcagcctcccgagtagctgggattacaggtactcgccaccaagcccagctactttttgtgtttttagtagagatagggtctctccatattgtccaggctggtcttgaactcctgacctcaggtgatccaccggcctcggcctcccaaagtgctgggattacaggtgtgagccaccgcacctggcctaacctttccttttgattcctccttagagtttttatctctctgcttacattacccatctcttcttgcatgttgtctgctttccccattagagcccgttaacatattaatcatagttaagattccatgattggtttttagatttttagaataaatgtttttaaagaaccaggcttctgccgggcgtggtggctcacgcctgtaatcccagcactttaggaggccgaggtgggcggatcatgaggtcaggagattgagaccatcctggctaacgcaatgaaaccccatctccactaaaaaatacaaaaaaattagccaggcgtggtggcgggcgcctgtagtcccagctactctggaggctgaggcaggagaatggcgtgaatgtgggaggcggagcttgcagtgagccaagatcacgccactgcactccagcctgggcgatagggcgagactctgtctcaaaaaaaaaaaaaaaaaaaagaacctggcttctttactgtttactagcgaactttggaagcatcatttacatgtattatcaaacctgtttttattttattttattttgagatggagtttcgctctgtcgctcaggttggagtgccgtggcacaatctctgctcactgcaacctccacctcctgggttcacgcggttctcctgcctcagcctcctgagtagctgggattacaggtgcgtgccaccatgcctggctaatttttgttatttttagtagagacagggtttcaccatgttggccaagctggtctcgaactcctgacctcaagtgatcctcctgccttggcctcccaaagtgctgggattacaggcatgagccaccacacctggctgaaacctatttttattattagtgctcatgatttctcatttaagaatatacataatcacacagcttacacacaaatattcatagcaacagtattcatagtagcagaacaacaacttaaatttccatcagctgataggtgcataaataaaatgtggtgtatccatacagtgaagtattagccagaaataaaaagcaatgaagtacagtcatgtagcatataacaatgtttcagtcaatgaaggaataggaccacatatatgacagtggttccataagattatactgtatttttactgtaccttttctatgtttagatatgcttagatacacaaataccattgtattacacttgcctgcgctattcaatatattaacatgcagtataggtataggtttgttgcgtaggagctgtaggctataccatatagcctagatttaggctgtattatctaggtttgttaagggacactctgtgatgtttgcacaatgatgaaatggaatgaaggcacatttctcgtaatgtatccctgtcattaagctaggcatgactgaaccgatatgtgctacaatgttgatgtatttgaaaacactatgctaagtaaaagaagccagtcacaaagaactagatattgtgtgatgccatttatattaaatgtcctgaataggtaaatccataaagacgcaaatacgtaagtggttgtcaagggcaggggtgaataggtggaaggttgggttatatgaggttgagggggtgggaatgggagcaggggggaataacagctaagggattttgagttctttttgggataatgaaaatgttctaaaattgattacagtgagagttacacaactctgaaatatactaaaagccagtcgtgcactttaagcatataatatgtgaattaatatctcagtaaagctgttaaagaatctagctgatgtatgcaaaactgctaagaacactatgatgtcatacagaaattttatggaaaaatattactttcctcatgacactgatctcaaaaggtttcctatctcaaacattgttagatttcaaaaataagatgttaattgcactcacttcaaattttaaaaaaccttattcagtctttttatagaggtcatcctgtaattatatggtcaatatgaattccagcagcatatctttttcatgtgtcaagaaagtttacattgaaaagattgcattcttaaaaagaccatacccagatccatctccacttcctgtttgtccactaaacatttgtgagatatttatggctatcttgcgcaatgcctccagaaatcaatgtttgctctcaagtttataactacagtttaaaaaaaattcaccaaaaaattcataatcctggtggatctgctgtttaggactagttagttaagtgcagtatatacaagtagaaaagctccaattattttacttgagatgatctgatggctaattctctcacttcctttgtgtgtgtgtgtgtgtgtgtgtgtgtgtgtgtgtattttatatattttatatatatatatttttttatttttattttttttgagatggagtcttgctgtgttgcccaggctggagtgcagtggcacgatcttggctcactgcaagctccacctcccgggttcacgccattctcctgccttagcctcccaagtagctgggactacaggcgcccaccaccacgcccagctaattttttgtatttttagtagagacaggatttcatcatgttggccagactggtctcgaactcgtgacctcagacaatctgcccgcctcggcctcccaaagtggtgggatttcaggcgtgagccaccgcgcatggccgcatttataattttaaaagcttaaatgtgttttttttttttggcgggcgtgtgggttgggggagatggagtctcagtctgtcacccaggctctagtgcagtggtgtgatctcggctcacttcagcctccgccttccaagctcagtcctgccacctaagccacccaagtagctgggactacaggcgtacactagcacacccagctaacgttttgtatttttggtagagatggggttttgccatgttgcccagtctggtttcgaactcctgggctcaagctatctgccctccttggcctcccaaagtgttgggattacgggcatgagccactgtccctggcaaaaaaaaaaaaaaaaaaagatagaattcaaaaattgtatcttgaatttagtgttgctcatatgacaacttactgtaaaaggtaatttattttaagtataggtcacatactatacaggggatgctttcaaaagacaattcctattgataattgtattttattattaaagtcaaagaatgtcttagtctgctttctggtgttctgttctagtgttctggtcttctagggttagaaactaggtagtttataaaagaaaggtttatttagcacatgattctggaagctgggaagtctgagatctggtcagcttctggtgagggccttgtgccatgtcgtaacaccacggtggagaagaggaaggggaagcaggcatgtgcaaagttaccaacacaagaggtggtctcactttgtaacaacccactctttagtccaaacctgtgggagcaagaactcaagggagtgagaaaggcattaatccatcttaacgacttacttgcctcttaaaggcaccacttccgaataccacatcgcggaccaagcctcaacatgagttttgtggagataaactatattcaaaccatagcaaagaccaaaggttatggcggtttactttctgctaagctttcagatatagacatgaaaatcgttagatcggtaataatatagctttatagtacttaattttgtaacttaattaagaaatagaattagcctaaatatcagctcaataatctaataaaaggtgaactgctgtacaaatagtccagtttgtatcactgttataaatgagcctatctcatgtgccaaacttttagagtaattgccttcttacgattttgtctgtttccaaaaacttctaattggagtatgcttttgaatctgtgtaatatttaacatataaagcctgcattatttagaagttgatattgaaaacctttaaacttctgacctcaaatagaatttgcttatgtataaccattacatgcagctggtgggttcaaaattgcgttttctgggtctctgctctgtgaaaaatagtatgtattggacatgagtacatgacagctgacatttatcaaggataacagggggagccatattcattttcacattttaaagcaactttgaaagctttgcatgtgcacacatgctcaacatatgttcctaagctttaaatatattttccatcatgtattgcttatcattaatataagaaactaagtgtaaatctttaatgagctcaatatattaaacttatatgagtacacaagcatttggaagatcagcaatgcaggctacttcattcatttacatggaatttatcttttatagtttctgtgctattacaaataatgtaacacattccagatagcccttttgttatatagtgtttgatttggcccttctttaatttcattaccataaaattttgtcctgttgtagaagactaaatggtagaaattaacttttttctaaaccaactattgttatattgctgttctctttgccaagctatttatagggctattttactggagggtgacataaatagaattggaatggcataattgttagtctgagttcttagcctttaaaaattttctttaaattgtgataattcaaaaagaattctagaataaaactgtaaagctcataatgttgccaacttgttaattaaaataacaccttttgtggttggtataggtttcagatactgtgaccatttaatatatttatatgcagatcacattgacttgctgcaaggtaacaggagaaatgctttgacttcagaagataaattggccatgcacagctgtaatcctactgtcttttcatttccagacatgattcagtagtttaaggctttgattcctaggcgctgagaagaaagttgaaatttatttttgtgtatgagaatttttacttaggtttttgataagtctagtttgtggtgtgaaggtaccatctaaactgttggtgtttccatacttaaatagctctctcttaattttatttgaaatatgagaagcctgagtttctttccattttccttttggcagttggaaaggaagccatcttattaagagtgatgaatagtgaagggttttttttaggctaaattgccagtgtctttagattaaaaaaaattgcagagcgataagttatgaacgttaacatgatttttcaaggaagaagtaatccttagtcacttgtaacccaaatgcctttcctaataagagttccgtttctacaaattcttttgacagagaagtgtatgatatcagagaggtttttagaaaacattttaagtgccataagaacaattcaagaccactaccaaaacttcatttgaagatcttagcatctttgagaatttagtatttctcaagagacatctcttaaattctcctgtaggcaccaagatttagacaatttgcttaatttattcagctaattaaatgggagagttccctgacccccctcacaggacgtgcgacagggctgtggctcatctgttccgtgctctcaaaccccttttgggaggaggagcatgcgtgcaggcaggtgcaggatctggggcgagtgcccctgggctctgttctcatgggagtgtccaggggtgggagtctgcaactccccaagcccaagtaggcatgtgttacagtatgctctttttgctttgccgaccatggacggcttaagtgttaaacagctcagggccttcttggtattcaggtccttgtccagcatcgaggaagaatcaggtcacacacggacttgaggatggtgaatgtggggattttattgagtgatggagttggctgtcagttggatggatgaggagctggaaaggggatggagtgggaaaatgatcttcccctggaatttggccatccagtggcccatctcctctctgaccgtcctcagccgaactcctcttggtgttcagatgttccttctcttctttctctgccgtgccattctgccattcttctgctcttctgtttgtctccttgtggagccgggggcttggggtttatatgggtacaggatatgggggcgtggtgggtcaaaaggcaacttttaggcatgaaaacaggaatgtttgttctcatttagggtcatgggttttcaggcttgagtggggcctttgccagggaactgccttcttctacccagtatttccctgtctcctgtctgtatcagtaatataggaattagaaaacacaaatatctttttttgtaaactaggttgtagatctgtttgtagttaagaggccaaattccatttttcttaattaccttgattctgtctgtaaatggtacagttcttgagggagccatttttcgagagcctaccatttgccagacatcactgaggttttgttttacctgtggtttttaatcctctcaacaactttgtaaaggtgatggatgtgcattttagagaagatgaaattgagcttcagagatgtaaatttggtaaggtcatgctgagctcaaatcagctgttaagtctgtgttcttttcccctcttcactatgcttcatttaagttggattcgttgttttcttgttcactaatgatgtgtgcttgtgtgtccagtttaggaattaaccttgtctattgattcttggtttcagacaagtatcccatgtctgtctagagtttggctgtggataattgatgatactatcttttcaaattatttataattcgtgaaagcttatagttcttttaacatccatttattcttctgtttctttttatcattcgtaatggctttcaattattattttaaaaatcgagatgggagcttgctatgttgcccaggctggtctcaaactcctgggctcaagtgagcctcccacctcagctttccaaagtgctggcaatgtaggcttgagccactgtgcctggccaattctttatctcattaaggatcataaacatttattttaaaccaatttcaagatttttattaagcattgaattcatcttttgatattgatgaatttcttgactatcttccttagttcagttattttttatttttatttattttttttgaggtggggtcttgctctgtcactcaggctggagtgcagtggcgagatctcggctcactgcaaccttcacctccaaggttcaagtgattctcctgccctcagcctcctgagtagctgggactacaggcgcatgccactacccccggccaatctttgtatttttagtagagacagtgtttcaccatgttggccaggatggtctcgatctcttgacctcgtgatccgcccgccttggcctcccaaagtgctgggataataggcgtgagccaccacgcctggcccattagttcactttttaaatacactttaggattttagtttatggtttatatgctgagtgggaaataatttttttccctttattttggtgttcttttctgtatgtctccctgccacctatacctctgtttttgttgccttcatacatttacaccatgctttcagtctagatctaggattctaattctgagatattattgcaatgttggtgatatgcattacttaggttttgtttgtgtgtgtgtgtgtatgagacatatatatattattattatgtatatattaccttttatttatttagagtaccttttatttcctctacaactgcctgtggcagtttgaaataataactttagctattgataataccttttttcaccttcctttcatgagttttttgtttggtttctacctatgagattttttcgttttacctgtgagccttgcttttggttttcttatcttgtgcatgatttcatttcctgactgcctttgcttgtttcttgtcctggagctcagttgggttcatggagttattaatttattgctttatatttcccctctgtcatggtccacaaatatatttgtcatgtttgagcgtaactgtgtcttttgaagttaatacaaaattcgtattttatctgtcattattatatttggagcaatgggataaggtggtgttgattgatagcagcatttctctgttatcctttcaggaagtctccatgttcttttgatctcacaacatggcttgtttatataggcctgcagatagtagatactaaagcatctgtttatttacttacttatctgcttacttgctttatttacttaccaccacccctgactaatttttttgtattttgtagagacagtgtcctgccacattgcccaggctggtcttgaacttctggcaagtgaccctctactgtagcctcccaaagtattgggattataggcatgagccactgctcctggccctaaaacatttattacatgaacgtggggtatcttggagaagccagacccagtttcaggctctcagccccaaccttaatctaatatagtggctctcaacgtgtggtgcgtggactcccggtagtctctgagaaccttttaagggttctacatggttaagactattctcataataatgctaatgtgttatttgctattttcatcccgttggtgtttgcaccgatggtggaaatgcggtgatgcataaaattgctgacaccttaccatgaattaaggcagtggcgccagactccgctcctaggtagacattgcattcttcactgccaggagctcataaagaaaaaaaaaaatcagttttccactgaggattgtccatgatgaagcagcaacactacacctggccctcattcccttttttccttaagtacctttcactgtacccttaagtactgtcgttttaatgttctgtgtgatgagaatggaaaatgtgcacaaagacttctgcctgccaaagtatgatggctgtctccgggaaaagcacttgcgcagtttgcgttgtgaactgaagtacccacttttttcatggaacaccatttttacttggatgagtgacaaaccatggctattgagtcttggttatttggagactgtcttcaaattgagtgaggtgaacctgtcactacagggaaaacatctgactgtattggttgacagtgataaaatttgagcttcaagtgaaattataagtaagtaaacttgaatcggccaccatgagcataacagccttttattactttcctgatgagatgggtggtgacattaatgaatgtgggttaaaaaaattgtgtaatgaaatgtaccagcatttgaaagatctactttaactcagtgaaccagtattatctaaatgacccggtgtttgattatacagtgatgcatgggttaaagatctgttcagagtgcaagttagatccaatgcattttaatgagacagcatgaaaattcatttatatggtttcagattccactttgcaactgtaggagactagaatataccaccctaaaatatgcctgtttggtgtaaggattattttgagaagcagacacaggagaagttctgaaaacagagtagaagttacccttttgtaagggaaaatttatatctataaaggaaatctcccttgtaagggtgtcttcctcattaccaggaaaaggatgactcaatcactagaaacttactaatggagaaggcatagacttaaatctgtataacaagccttactgttgtttaccatgcttttcttggtcacctctccataactattgctccctagcccctgtgcccttctttatttgtttcagctgaagatgatatttaagtctgaattctaagccacctcttagaaatgaaaagatttactcatttctctgggtatctctcatggatacatgagatatatttattatatttctgattttctcttgttaatttgtcttttgttaaggggtctgacccaacttagaactcagatagggtagaggaaaaattatttttttctctcctataaaactcacctttaagaaattaccagttgttttagtgtaatatcaagaaatatccataattatttataaaagtttattaaaatagtccttccttttacaagtacatgtctttgtgaggccagattttctttatatccttaaatcaagataacattgcaccggattgaatgcagaagtaaataactgttttctattaagtcaggtaattatatgcaaatatatgtttttaattattttataattctcattgtttcagaagttttgttttttgcaaaaattgttatttatgttaatatatgatgggctttaaaaagtgaatgagggccaggtatagtggctcatgcctgtaatcccagcactttaggaggccaggcaggtatatcacctgaggtcaggagtttgagactagcctggccaacatggtgaaaccctgtctctactaaaaatacaaaaattagccgggcatggtggcgggcacctgtaatcccaactacttgggaggctggggcaggagaatcgctcgaactggggaggtggaggttgcagtgagtcaagattgcggcattgcactccagcccagcctgggtgacaagagcaaaactccatctcaaaaaacaaaacaaaacaaataaaccaaaaaagtgaatgagtccggcttggtggctcatgcctgtaattccaacactttgtgaggccgaggtgggagaattgcttgagcctaggagttggagaccagcctgggaaacatagcaagacctggtctgtactaaaaattaaaaaaatcagctgggcatggtggcacatgcgtgtggttccagctactcgggaggctgaggtgggaggatcacttcagaccagcagatcgaggctacagtgagccgtgatcacaccattgcactccagcctgggtgacagagctgagaccctgtctccaaaaaaaaaaaaaaaaaaaaggtgaatgtttcttaagttttaatttctaatatggtgaatactgacataacccacatagcagaagttattacaggtttccagtttttaagaggtaaaggaatcctgagatcaaaaggcttgaaatctagtgaatttggttggaactctagaagcatttgacttaaacctttcaccttgttgtatttggtatcttgtagcacacccagttcctgctacagctgcctctattctgtgctgcttaaatacggaggaggtctgagctaaccaatctgaagtttggccaatttcaggggcatttagttgttaacctgaatctacttcttttattagtaagaaacatatctactatagagatttaggactttgaacagctgtataacattataggatatgtctggtactcagttgtttctgtttctgaatcacaaatcggccattaattttaaataaagacgttttgtagcatataatacaatttctgatgatctacttactagtttgttaattcctcacaccgagtcatcagctccttgaaggcaaaaaaattcctgttttgatcaacaattcatctaccccaagcacttagcataggggatactatttcctttttctatgtggatgacacccgatatgttgaacagtgaccactcttaagatacttggtgaagtaggttttggttttaaccagtttaggtgtatggatgattttacagaagttcgtaataaaattttcttgcctcagatattctctaataataatgaggtgcccccagcttcatttactagacatggataggcaggttttgtgaagtacagaaaaaaagttctttaaagttatggatcatgtcacgaggtcaggagtttgagaccatcctggccaacatggtgaaaccccatctctactaaaatacaaaaaaattagctggttgtggtggtgcacacctgtagtcccagctactcaggaggccgaggcaggggaattccttgaactcgggaggcagagattgtggtgagccgagattgcaccactgcactccagcccgggtgacagggcgagactccgtctcaaaaaaaaaaaaaaagttatggatcatgaaactaacatttgaatagcaacaaagaaaaaaccaagctatgttgtattttattttttatttttattttttaatgttgtattttaaattgaatgatgtacttctcctcctctttgcagtattttatatttttgcttactgcacatttcttccctgaagcaatcttgacctaatggtataaatgtttagctccacataagacggtagctattttttggagaggaatggagagggtcaagggttttattgagttttcagttctgataccttttaacctttttaccagtgctaccccaccctccagaaagcaaataatgttgaaagctttttttattttttaactttttgatatatattttcttattcattatttgtattgttgtcatcagatgaataatggctttagagatttatttgaaaagacaaattctattatcagacacataacttctagggatatggaaactattattattgttactgttttgagacgggatcttgctctgtcccccaggccagagtgcggtgatcatggttcactgcagacttgacctcctgggctcaagtgatcctcttacctgagcttcctaaatagctgggaccacaggcacatgctgccatgcccagctaatttttgtgttttttgcagagacagaatctcactatgttgcccaggctggtctcaaactgctgggctcaagcaatcctcttgccccagcctcccaaagcgttgggattacaggtgtgagctactgaaactggcccggaaacatttttaaaaaaggattcttttgaatttaaagttatttaatgattactgaagagtaataagctgtgaggtcaggaaaaaaaggactgagccacagactaagcagcagtacagatgatgacctattcaggaagtcttgtgagtcagacttgccgtgtcgtgttgctagagttacagatctgctccaacctctttgctttataagaaggacatctctctgttctaccttcaatatcttttctttgaaaaatcaacccaaaagtcttttattagctttacatttatttctacagtcttaatttttgtaacatcagtgttgcaggtgaacaaactcattgtagcctctatttttgatattgctggacagggctaactttagtactatagtgggaagtttgttattttgttttttactctacaggcactctggtttaggaatatttatctgtcttgcatttgaccatggttaccattccccctcttcattgtttacttagtgtaccatggtacactttatgtaccatccttgctgctctcagctgtttggttaccaggtggctaatgttgtcatctcttaagctttaacatttacttctcaatactgtcttttcctctgtgaggtagatggaaagaatagattagaagagaatggggcatatgctgtgatcatctctcctttacatctttattgcttattaatttaatttatatcagatttcatttctgctctgtgcacatacccactgtccctcctcaccactcttctttatccagttctttctcacttaccttagcatggctaaaacccttggtttttatttatctctttcttcctctgctgtttttattttcattatatgccacagggacaaacttaggtataagtactacttttgatgtagagatacttatgtctgtcaaaggaaaattaaactacaaaccccagaggtaaaaaatggtacacaatactggggtttaaaaaatctcctcctcggccgggctcatgcctgtaatcccaggactttgggaggctggggtaggttggtcacctgaggtcaggagttcgagaccagcctggccaacatggcgaaaccccgactctactaataatacagaaatgaggtgggtatggtggcagctgcctgtaatcccggctacttgggaggctgaggcaggagaatcgcttgaatctgggaggcggaagttttagtaagccgagattgcgccactgcactccagcctgggtgacagagcgagactccatctcaaaaacaaaacaaaacaaaataaaaaagccccactccttctgcccctccagaccagggtctcactcccttcacccaggctggagtgcagtggcgcgaaccttagctcactgtaacctctgcctcctgggctcaggtgatacccccacctcagcctcccgagtagctgcgactacaggtgtgcgtcaccacgcttggctaagtgttttgtattttttgtagagacggcgttttgccactttgcccaggctggtcttgaagtcccgggttcaagctgtcctctcatcttggcctcccaaagtgttgagattacaagtgtgagccaccacacccagccaaattatttctttttacctctgtaaaaggagaaccttctctgtattttaagaagatgtggagttggtcaaaagtacagctgatgggaaagcaaaggagaactggagtttgaaaagagaagaggaatggtggtagttaaaaaaaaaatttgtaaaaaatagagttacatacaagtttacacaatggtttagagcttacaaggtaggaagcagagacagaaatagtgtaatatgtaaaatgttatagtaaaaatatggaaaatgcttaggataaagaagggaaaacttttgtctaattgggagagtcggggatggttttaccagaggtgacaaattaatcttgaagggcaggaatattctagatggaaaagcgatgtgggaaagattaaaaaaaaattagtgacttaaggttaaaaataaaggaaatgtttcagttacctttattaaaaacttttagtataaagatcattttggggttgctggtggtgattgatgaggaagaagtatgactggtaacaggttgtttaaactgaagccaaattcaggtttatgaagctcagacttaagtctgttcttatatatgagatagattcagtgtattaaattgtagaagtcaatgtaacctttaaaacaaaagagttacccggctagttagtatgctgtcaggagagggtaacttgatttggatatggatggaattggctcccttaactccctctgtacagtgtattatctgtgaacttcaactctgttgctcatgtagaggttgagaagtctcttggcagcaagtttccagttgcaactaacacctgagttggctaattggtatgcccagttctagcactctagtctctggggagtttatgtttaaattcaacttcatcaggtttaaactggaacataaatgtgcaagaaggaagagagaatggaaccttgcgcataaaataatttacattcagatgcttttctgttcaatttatatattaaaaataggatgttttactttattgtttcttgctagcccttcactcaatatgctggcattataaagcaaagatagtggagaagaaattaccaagaactgaagttgtactgttttcttgtatacatctccaccaaggtagtttcttgtagataccatgtgtatgttttgtttctaaaaactgtaggctcctagctttgctattcattgtgttcaaacgattccttctttttttttttttttaacacttaccaaatttaattgtttttctgttttcctgttctgctagcctgagagttctagtaattggtagtgacatttatccctgttttctggggctaaaatgattctgggcatgcaaaacgtttgagctgaaatggaattaaattgaaaaaaaaaaaaaggattgtgttatactttatcctacaaaacataatagcaaattatcagccacaaaacaaaaggatataaaaaatttccctctctgacagaggatgaggaagcaaaagaaaaataaataagtaggccaggcgcggcggctcacgcctgtaatcccagcactttgggaggctgaggccggtggatcatgaggtcaggagttcaagaccagcctttccaagatggtgaaaccccgtctctactaaaaatataaaaattagctgggcgtggtggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttataaaagctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttcccaagaacttgttttttctgattgacttgagcagtctctgcttttgcatagtgcttgaagcagtttttaataaaccagttcagatccatagctctttgaaaaaatttccataagttactgtgattctcaagaaatacaccaaacctctctctaattagtgtatttaatcataccttgtataagttagggaaacaagcctgacagataaactaaattgctgctgggatagtcaagtggctccaccatttaatgatagcaaaccaaagaataacaatacttgactgaccattttaaggtatagtttgtatatgtcgatctcaaattttccttttgctgtgtgagccattgaccatctcaagtggaagtaagggttatgggtaatattagaccaccacgaagggcagtttagtgacatcggtgggtaatggttaggtaaggtacttgaggggagcattagtatctgctgagcttgagcaactccttgcctctgtccctaatactgcatgcccctaaactatggctgtcataacctctcagtgttcttactgataagctgagaaattttctggctaactggttggctatagtgtgattcagtagtacaaatggcttgttttggtggtggtggggaataaaatgcccaagaaacatttgatacatattttgttggttatgaagtctgaaaaaatattgtagttccagctctgccatccagaatctgtgtgtgctctagtggaaagttagccatttccttatctgtaaaatgggactattatagtaatacatactctggagggtcatggtaaataaattacagtatatatgagatgtctagtattgtactaccacaaaattatctccttatttctcccttattaatttaggaaaagtaaaatattttagttggtttctatgtcaatttagatttactggataacccatctgctattttggcacactatagctttttttaggtccctcaaaataacttcttgcttgcctaatgaacactggtagtgttgattgatatcttttccttttggacagggcgtagttcctgtatccttgtccatttagctaatttgctgtgtataatcaaactttttccctcctgtcttaatcccaaataaccaaaaggaaagctgattagtgctgctaagccatataccaaaattttcatggtttttgagctagcaggtataattctttgctgcttttcagctttaattagttagttattccatgaaagttcattttctaacaatttattatatattctgttgatgtctaagcttcaacatgttccatagcttgaatgttacgtatagaaaggcctatagtatttataggaaacattctatccagttgttgtaagatacttgttcattttaaatcttatcatggatatactttggacttttccatataatatagaaatagcgttagattttgatagcattgaaaggtattctcattgttactattctacattaaagtaattgtgacgagacgtggtggctcacgcctgtaattccagctctttgggaggctgaggcgggtggatcacttgaggtcaggtgtttgagaccagcctgaccaatatggtgaaaccccatctctactaaaaatagaaaaactaggccagggtggtggcaggcgcctgtagtcccagctactcaggaggctgaggcaggagaattgcttgaatctgggaggtggaggttgcagtgagccgagattgcaccactgcactccacccgccccccgcccccaccccccgccccgccaaaaaaaagtaattgcatggaatatattgcttaaatgcaggtttttttttttggacggagtttcattcttgttgcccaggctggagtacaatggcacaatcccggctcactgcaacctccacctcctgggttcaagcaatcctcctgcctcagtcccccaagtagctgggattacaggcatgtgtcaccacgcccggctaattttgtacttttagtagagatggggtttcaccatgttggtcaggctggtctcgaactcctgacctcaggtgatccgcccacctcggcctcccaaagtgctaggattacaggcgtgagccaccccgcccagccttttaaaaatgcagtcttaaagtgtgcattgccatatttaatacatttaagtagtgtagcatacaactttttttagtggaaacattttagataaggaaaataattgtaaaaatggctcatggatctggatgatagagtttatattgaaagattgacttggttttagcctttgaattctgataaaatgagaagttcttccttccagttcttttctgtactttggtgccaggggcttgaaaaggcttctgagactggattgtgtatcttcttggaagtgcattagaggtgcagtggaaacttcaaaatatggatgcatctcacaattggatgtatgatgtaacttcaggaggacagattacttggtagcaagtataggtcctaatttcttttctattcaactataagtgataatatctaattgtagggagtcagaattaagaagggactctatgttaatagactgttcttttttttcttttttagacggagtctcactctgtcatccaggctggagtgcagtggcgcggtcttggctcactggcaacttctgcctctcgggtttaagcttttctcctgcctcagcttcctgagtagctgggactacatgtgcatgccaccatgcccagctaatttttgtatttttagtagagatagggtttcaccatgttggccaggctggtcttgaactcctgacctcaggtgatccacccgcctcggcctcccaaagtgctgggattacaggcgtgagccaccgcgcctggcctagactgttcttacaatcaaacttagtgtgagactgttgtgctatattatttgccctttgaagatggcttttatcaactacatatattctccaaactagatgggttgtaatttaagatgtaaaaatgtaagctagtctcaggtagttactgttccatgtttcttaccggttaagaacttcatggtcttggtacctgccttattcccctctctcatcttcattcttgactgttgactgaaagtgatctagatctattgtgtctgtgctaggcatttaccttttatatcttaatctaccaaaatagcatatcctcccagtgagaaggagataacaggcgtggcaactaaaacaaatgccatttttgattttttgtttatagctaagattaataccaaatagaaaactgtacctgaagggttagtcatagtcatttgtgctcaggaattattgtatatattgaaattattattttggggaccagaaatgcttttttatttctcatgttgaacattttctttagtttaatgaaattcaggagatgtttgctctactttgctttttgttataaaacaatttgtcatttactcttagacattgtggtatcttatacagttgtacagtaaatgtacctaagttttgtccatgtctaattaagaactacaaatctgtccaacctgttcctaaaaaacccaagatagagactggacatggtggctcatgcctgtgattgcagcgctttgggaggctgacgtgggcagatcagttgaggtcaggagttcgagaccagcctggccatcatggtgaaaccctgtctctattgaaaatacaaaaattagccaggcgtggtggcacacacctataatctcagctactcgggaggctgagacgagaatcatttgaacccgggaggcggaggttgcagtgaactgagatcatgccactgcactccagcctgggtgacagagtgagactcttgtctcaaaagcaaaacaaaacaaaaaataagatagaaatattttatatcttaaacaattatacctttatgttcgggtaaacacctttttcatgattttaagttattattttcccttagttttttttttttttttttttttatagacagaattcactcttgctgcctaggctggagtgccaatggcccaatcttggcttactgcaacctccatctcccaggttcaagcaattctcctgtctcagcctcctgagtagctggaattacagacatgcaccaccacgtttggctaattttgtatttttagtagagatggagtttctccatgttggtcaggctggtctcgaactcccgacctcaggtgattcgcccatcttggcctcccaaagtgctgggattacatgcatgaggcaccacacccggccttcccttagtacctttttggataattaggttggactctgaaggagtaagtttggtagcaggaagattgcacaggcttatgtgtacagtgtagcttgttttgtgagatcaagagaaaaagctgcatgtgtctatggacatagctcgacatatttaggtttcattatatgcacataaacattggcttaacacaaatgatctgcatttctggtttaaactgatatttgtgcttattaatttttttgcatattaagagattgtcatgacttagtttttctattgatttaatttatgctgtcagaatttattgtaacactatatcaactgtagaagtaaacatttaaaaagtttaatgcagtaggattgcattgaatgattgttatagatcagaataaaggaaatttctaaactatgatttagtaggttgaatgttgcttttatatttattcaatatttattcaagacatatattgaccacctattacatggtaggccccttactccttactgagtattcaacttatatttaataacaaaggaaataatattgagaatataggcaaaattttatctttcaaattaaagaagtgctgttatccatggaatagtttctccatttgtttcagggattcagcttataaacaaaagccaaagtaaggaaataatatctagaatgtggaataaattacatatttaaaataaagaaatgtaggctgggtgtggtgggtcatgcctgtaatcccagcactttgggaggctgaggcaggcggataacttgaacccaggagttcaagaccagcctgggcaacatagtgagaccctgtctctccaaaaaatacaaaaattagctgggtgtggtggtgctcacctgttgtcccagctacttgggatactgaggcaggaggattgcttgagcctgggaagccgaggttacagtgagctgagattgtgccactgcacttcagcctgggtgacacagtaagaccctgtctttaaaaaaaaaaaaaaaaaaaagttattactcaatggatagtttgccattcaatttaaaaatcacctttgaatgaaacaaatataaaaccaattatagagacataacaagaattattctatttttgtacttaaggaatggaatcactattctttttatttttattttttgagatggagtcacactctgttacccaggcctggagtgcagtggcgggatctcagctcactgcaacctccgccttccgggttcatgcgattctcctgcctcagcctcccaagtagctgggactacaggcgcctgccaccacgcccagctaatttttgtatttttagtagagacagggtttcaccatattggccaggctggtctcgatctcctgaccttgtgattcacccgcctcggcctcccaaagtggtgggattacaggcgtgagccactgcacctggctctttaattattcaatttattattattattgtttttaagagacagagtctcactcggtcacccagtctggagtgcattggcgtgatcataactcactgcagcctcaaactcctcaaacaagcagtcttcctgttttattcctaagtagttaatgctataggtgtgcaccatgatgcctggcttatttttaaaaaaattttgtagagacagggtgttactgtgttgcacagattggtctcaaactcaagtgcctcaaactcaaactgcctgagcctcccaaagcactgggattacttgagctactctttttaaatatgaaaattggaaaatcaaaaccgaacatacctttaagtttaaaactcttttatttgaggataattttaaacttaaagcaaggttgcaagaaaatagtacaaagagtttttacgtttatctcccccccgggtcaggattcacctagtgtcaactcccttcctcatccttgctctgcctgtccccattcccaggtttattcactcactcattatatatgcaatttttcttaaccatctgaggataatttgcatatgtaatagcctgttaccccaaatattatactaagaatattggtctcttaaataaccgtcgttcatttatcaacttaagtgtattaatattgacaacatacttttatgtctattgtccatattctaattttgtcagttgatccaataatattctttatagcattttcttaccctctagcacaggattcagtctaggatcaaatattgcatttagttgtcattttcttatagcttcctttaaaatctggactgtttacagactttctttgtcttttgtgacattgacacgtttgaaaatacaatacccctgagattgtgtgatctgactgtgccactactaataatagtgagccactactaataaaggttattttaagtctttttctgtccttcatttaaacttgtcatggggaaaaaacaaatacttaaatcatctcagctttttagcctttccattttacaaccaaagttatagaatgaattttcttggtaatttaatacatatttagtgcatctgtaaagacaatgttgcaatctagattttctgatttatattatgatcatgtgattttttaaatttttattttttttgtttttttgcttttgattttttttttaaagctacacatttgaagtttgatcagcatcttgagtgaattttttcatttttataaatctgtcttccttcctggtagcattctgccacctagtggaaatttatgtcctccagcatacgtctcagagtttagttggaatgcaagatgcattttaatatataaaaattagtttagaatcgttgaacttctttggttgacatgtaattctttacaacagtgatcgtcttgttttaaacaagagtttagtacagataaaattcttagcaaatgagggcttagtagatgtcttaaatcatctttctcaacaagaagtactctacatttatcttcttcatcaatgaaattttaaccaaagcatactatttttccatcagtcaaatttttttttttttttttgagacggagtctagctcttgtcacccaggctggagtgcagtggtgccatctcggctcactgcaacgtctacccctcggttcaagtgattctcctgcctcagcctcccaaataactaggattacaggcacctgccaccatggctggctaattttttatttttagtagagacggggtttcaccatgttggccagacgggatttcaccatgttggtcaggctggtctcaaactcctgacctcaggtgatccacctgcctcgacctcccaaagtgctgggactacaggcatgagctaccgcaccctgcaagatacacatttttagtaggacttgaggaacatttctgtcttggagtacatacgttctgcataattcatattagaatatgaaatctgaggttgtcttcagtatagtcatttatgaaaaagaatattgagaattatctgtttagagaaagtagttctgaattaaaagttgcagtcattcagtcatataacaccttcatagagtcatgtatattttttaatgtacttatcttatttctcattattctctcttagttgctgatgtatattcaagatgagtggattaggagaaaacttggatccactggccagtgattcacgaaaacgcaaattgccatgtgatactccaggacaagggtaggtgacttatttcctggtgctttaccacacttgttgtgcctttgtttaaggataacattttaacttcttgccatttacattctctggttagattttttggtggtttcacttcgtggtaagtagagtgttactgatgagatggacatctttttgatgtaatagaagttttttttttattgctgattcatatagaaggtagaatattaacaattcgcggtactataagaatttctgaatggaaggaggggtaggagttacgaatagatgaccaaggttatgtcacgtgcgtccgtgtgaagagaccaccagactttgtgtgagcaacaaggctgtttatttcacctgggtacaggcaggctgagtccaaaaagagagtcagcaaagggtggtgggattatcattagttcttataggttttgggataggcagtgagttaggagcaatgttttgcgggcggggttagatctcacaaagtacattctcaagggtagggagaattacaaagaaccttcttaagggtgggggagattacaaagtacattgatcaagttagggtggggcagaaacatcacaatggtggaatgtcatcagttaaggctattttcacttcttttgtggatcttcagttgcttcagaccatctggatgtatatgtgcaggcttggtctcagaggcctgacagttataagtaagaatctttgctatcttttaagaatgggttataagttgatattttgtcatttgtgaggttgcatccttttttttaccaagtgaaatgagaagcttaaaaattagaaacaaaataatgtaatctatataacactactctatagcttttaaagtatttgccaaagtcagtgtcaattgaagtttaatgtgctagttgaaaaatatcaatctacaatgaataaaacttcatcattaataagtagctaccactgtttttgttcttatttgttagttgttttattatctctaagaagtaaagatgatttattcgtattttctagatgaagtaactgaggctaactctgcccaaggccacctagctaacaaagatggaactgaatttaggtttacatgaatctctattatgttgtactacttctccaagacagcatttttgatagtttatattggctgagtttagtttgtttacatatgaaaataataggccgggtgtggtggctcatgcctgtaatcccagcactctgggaggccagggtgggtggattacctgaggtcaggagttcaagaccagcctgaccaacatggtgaaacatcgtctcaactaaaaatgcaaaaataagccaggcgtggtggcgcatgcctgtaatcccagctactggggaggctgagtcaggagaattgcctgaatcctggaggtggaggttgcattgagccaaagtcgcaccgttgtactccagcctgggcaacaagagcgaaaactctgtctcgaggaaaaaaaaaaaaaagtaatcatgtaatagtgttgtataggggctgattctgctaacagctcttttgtgatatatatattatgtctcctttcccccctttctacgccttttcccttagtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggtaataaaaacactcatgtctttttgaacagtggtggttcccaacctttttggcaccagggactggttttgtggaagccagtttttccatggacctggtagaggggatggtttcaggatgattcaagcacattacgtttgtggtgcattttatttctattatggttacattgtaacatataatgaaataattatacaactcaccataatatagaaatcagtaggagccctgagcttgttttcctgcagctagatggatccatctgggggtaatgggagaaactgtgacagatcattaggcattagagaatcataaggagcacacaacctagattcctcgcatgtggagttcacattaagatttgcacacctgtgagaatctaatgctacttctgagctgacaggatgtagaactcaggtggtaatgtgagtgatggggaggggctgttgttaatacagatgaaactttgctcacttgcccactgctgacctcctgctgtgcagccccattcctaacaggccacagactgatacttgtctgtggtctgggggttggggacccctgttttagaaggaacttgttgctatatttgcctttttgctcctttgtttgggtagagactacaactgatggaggctagcaagtatgggaatagacaaatgtgttgaccagctgtgctttttgttatttatgtatttatttattttgagatggtgtctcgctttgtctctcgggctggagtgcagtggtgtgatctcagctcaccacaacctccacctcttgggttcaagagattctcctgcctcagcctcccgagtagctaggattacaggcacctgccaccacgcccagctaagttttgtatttttagtagagatggggttttgccatgttggccaggctggtctcaaactcctgacctcaggtgatccacccgcctcagcctcccagagtgctgggattacaggtgtgagccaccgcgctgggcctccagcttatgctctttagagacggttaacagacaattgcctgttatttggtagttccttttcaggaagctgtgggatagtacatttagtagtgaaatgatttaggtatcttctggcttcctgggcaactatgaagtttagttttgatgttataatattgtagcatcattctcttatgaggaaatgttttgtatgtatgtatgggcatgtgcatgtgtatctttatgtctcttctggggactattcgaaggtgatttaatctataactgatagtgtgttattcgttataccaccttctgtcttttcaggaaaaactatttccaatgatgatgatgttcaaaaagccgatgtatcttctacagggcagggagttattgataaagactccttaggaccgcttttacttcaggcaagtataaagattttaactgtccagtaggctgtattgccctttggtttattataaagttataaaaaatcgatgaaattttggttaggaaatgagaacaaaaagaaaacatttttttctttgagacagttcagtattctgaatatgatggtaaaatgctcttataattacaatatacataattcaggaagccttgcccccctagtaaaaatatagttgcaaactgaggaaccacacatatacaaacataaaaatataagcaagcaggaaaggaaaggtagcctgtaatttcacagagatatttgggtacaaatggcccttcatatccatgggttttgcaccacagatttggaggctgaggaagaaataaaaaataatgttaaaacaataaaaaacacctcagtgtgatgactatatagcacttacattgtattaggtattataactaatctagagatgatttaaagtatattggaatatatgcataggctataggcaaatacaccattttatattggagacttgagcatcctcagattttgctatctttgggaggtcttggaaccaaccttacacagatactggggtatgatgactgtacgtttcggctcagacatttttggtgaatttttgcgtgattgatcacatggcacgctatggttttatattcttgaggaattgttaagacttaaacatgtgctttgtatttgtttaggggctgaagcccttcataaagttaacttgtcaacttctttttgtttcaggtagtttgttccaactacttttagttgatcagttttgaaattcctctttgtaaattctcattaaggaatagtagagcagtttctgtagcttgacttggcatcaaatggaaaaatgggaagagctaaggatgcttttctcatttttaaaagctcctttaaagatataattctttaaaaattaggttagacattaattcagatttcatgctgaacatatttatgtacacactcccccacccccaattattcttctttttttttccccccagtaaggcctgtagtaatggtgctaatgttagtagtaatggtggcttatagttgtttgcagtaattaagtcagcagtagtttttacacattctacttactactgtggttgctgtttgctgatactaccataacaaaataccacagacttggtaggtgaaaccaaataaatttatttcttacagtgttggtggctggaagtccaggatcaaggtgtcagcaggattggcttctccttggcttgtcactgtgttctcccatggcctttttctctgcgtgcacattcctggtgtctttctctccccttataggataccagtcatattggattagggtccccaccgttatgacctcatttatctttaattacctccttgaaggtcttgtttccaaatacagttacactgatggttagagtttcaatttaagaattagagggaggaggatacaattcagtccataacagcctgtattaacatatcctattttaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacaggtaggcttttaatgtgtattttctaaataggttaaatttttttccttgaccatttcttagaaaattgaatgtatcttttaggaagtcaagcgatcaaatgagggtagaaaggcatgtgatttaatagcagaattttcacatatggagtcagtgaattaaaaatttggtatacattttaagaggcatatagttacaaaatatgcagtgagatttctgttaaagttgaaattattcacatgttttgtatattgccagcctgaaatgttagtatagatataactatggaaaacatgcataatgagaaaatgcagcttgaattcttgatgatggtcatagaatgagttaccagctttttaaaatgtcatttcaatttgttttccaaagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaaggtaagagctattatatgtttgtgatgttcatgaaacaaatagtggccatacttggagttttgaaacttgtgttgtaacccttcttactgaattccatgtctttgcttgcctattgaacatatatatccaaaagttaagtataatccttaccagggtgaattttttattgtagatttgcaatcttgtatgatctgtgtggcacgccgcattactacaggagaaagaacatttccatcaaaccctgagagctttattaccagacatgatctttcaggtaaaaactctttttttgtctctctctctctctgtgtatacgtacatttttattttggaaatttttgtaaatgttactatttttaatctgtactatcatagaaatgtatacctactgtaatgagtgctttatgtgtatcttttttcatgttgcttatgcaaccttaaaagaatttcactaaaattcttggcatttgaattgggtatgtttggcattttaaatcccccagataaattaaaaaaaaaatttaggggcacctggttttctctccaaattgcattttgcgtcagaatttagtatttctttaacttcaagcccatttgtcataaagaaacatgttttaaaaaattataagtaatttaatgagaattattgggagtaattcctttttttttttttttttgttgagacggagtcttgctctgttgcccaggctggagtgcaatggtgcgatctcggctcactgcaacctccacttcttgggttcaagtgattttcctgccatggcctcccaaacagtttggactacaggcacgtgccaccatgcccggctaatttttgtatttttagtagagatggggtttcaccatgttgtccaggctggtctcgaactcttgacctcaagtgagtcgcctgcctcagcctcccaaaatgctgggattacagttgtgagccactgtgcttggccgggagtaattcttgacgtcaacctgagtttcaatcttggtctgccattttttaatcatagaaataaaaaattaaagacatcgtggttgataagatgcattaatgaaattaaacactgtggcaatattatttttatttaccttcagggttactcttatggtcacctaagtgtaaatggggatgccaagggtttgtcatatatgccccatctcagagataaagaaacagaagcttggtgacagagattgggttattgtccaagatcatggctaataagaaaatttatagctgagtctgcctgacttagcctgtattctttgctttgtgtaacactaattttacaatgtggacttttaacaagtgatataaaaatggagtaggtatacataaaacatagctatcactattacatatgtatgtgtgtgtttgtaatatgtatatataatatacataatgcagaatatttttaaagaaatattgctatttttgcagtcattcaatcattttatgccatcagtaacctatcttcaggatttttgagattaattttcacaattaaaagtagcaaaggattattttgacaattcacagtataatcttgtttacgctgatggatgttacttttttttttttttgagacggagttttgctctgtcgtgcccaggctggagtgcaatggcatgatctcagctcactgcaacctctgcctcctgggttcaagtgattctcctgcctcagcctcccgagtagctgaaattacaggcgcccatcaccacgcctggctaattttttacatttttagtagagacagggtttcacaatgttggtcaggctggtctcaaagtcctgacctcaggtaatccgcctgcctcggcctcccaaagtgttgggattacaggcatgagccaccatgcccggctgtatgttactttatatttgaacattttctctgtattaactcccctcagataaacatagtgacagcaattgttatatattattttatccttttagagtgagtctttctctgcacctcttatgatttggcagtgttaattttctacttgaatagccatgttttacatttgctactgaagatactaaataaaatatctttaagcaatttagcaagtagcatctttgaaaattatctcatcagtatataaaagtgatacatgtttattataaaagttagaaattaccaagcatgaaagaaaacaggacatgatggagaaaaaaattgccaagcaagaaagatcaaatgctttgtgtgattaacatcatttaaaactgagatcctacttacttttgacctctggggatattttatcttctgtccctgatgtgtttcatttaataaactttttatggacatctgttttgtatttgtcatgtggcccagggctaaactcaggagaggtggttgaggacaaatcatgtctattttgggcacgagtgcacaggtatttactctttcccagaatgcgtttatcccttttccctagtctccccctgctactaataagatttttggtcaccattaaaattctgaattttaaacagattattggactggtggtttatttctgtcagcttattcaatattagtgccttttaaatctccagtagcttttgcagaattacctttcactatgaagccccatgagttttcccaaaccaaacttggttttcttcagtatgttttctaatgaatatgtcatagaaaggataaatatatgggcaagactttttttttttttttttttttttgagacggagtctcgctctgttgcccaggctggagtgcagtggcgagatctcggctcactgcaacctctgcctcccgggttcaaaccattctcctgcctcagcctcccgagttgctgggactacaggtatgtgccaccacactcagctaattttttgtatttttagtagagatggggtttcaccatgttagccaggatggtctcgaactcctgacctcatgatccacccacctcggcctcccaaagtgttgggattacaggcacgagccaccgcgcctggcctgggcaagccttttcaatgtctttcctaatttgtctggagtcagtttattgcccacttctttcaagttatttgtctgtaccttttgggtcacaacttccatcatcattgggatttggcatatctgttggtgctgagcataagagattgcccaagtctgattattgcatttcttagtaaaacctatacaaaacagataactattggcaatcttgacatcagcaggagcttcctatgaagtctgccatgtttaaccatggagcatattttgtcacagaaaagattactgaggatgtccaggtcaaaaactgtgtgaccagttattatggcttggatcattctgtctgcattcaaagacatagaaaaggcctgaaagctgatccaagaccagccatggaagctggtcacatagtttttgacctggatgtcctcagtaattagtctgaattttctaagggcagtttcatcattatgcagatcagcaaggttcatttcaaaaacacagttcttgaggccatcagatgcagttttggttccttgagcccttttgactagtttgttaccaattaaacacagctggtgctttcacatcatatcagtcttttttaggaaatggattaaccactttcttctttgctcccattctgccactttttgtaaggcacttgcttttgccaaccaccctagtgctgcttagagtgaaaaggcctagacagtttttaaggaccatctattgtcatgaaaccttctttaatttcatagtatttttgagtatgtatatttggtgtctccattgtatttgatattaagcaaaagttgtcagaagcttccagcattgtagaaatgagtatttggttaaccctccaagtttaggtattaagtgtacaaaaatgtgatcatctctcagatgcaaataattgtccctgctggcttactttaagtaggtattttctcttgcttatagttgtagggacagaatctcttcggacaaacaactttcctcataggcgttattttttccctttacacgaaaatgaacttaaggttatctggacatgtatattcagtacattcagacagtaaaaggagtttgtgtgatatatattctgtacagcatttgggaaaacactgtttttctacactgccacaccacttctgaccccagatgtatttttttctacactaaccagcgctctgtctgacataagctgggtgccctacaattttagtttggacagtttctacctgggtttagcattagatcttacaaggttaagggttcagtcccacaagactgcctgtactttacttcagatgccagttgcaagtcctggccttctgtacttctgactgactggctataaattgggcttctgatcctctccttaggtttgatgatttgctagaatggctcaagaaatccggaaatgctttactcaggtttactggtttcttatgaagggtacaactcaggaatatctcaatgggagaaatgtataggagaaggtattagggggtggggatgaggtttggaggttccatgccctctctgggcttatagccttcccagcaccttaatgtactcatcctttggaagctcatcaaatctcttgttcaagaggtttttttttttttttttttaattggagatggagtcttgctctgttgcctaggctggagtgcagtggcacgatctcagctcactgtaacctctgcctcccgggttcaagcaattctcctgcctcagcctcccaagtagctgggattacaggtacgcaccaccacgcccagctaagttttgtattcttaatagagatggggtttcaccatgttgaccaggctggtctcgaactcttgaccttgtgatctgcttgccttggcctcccaaagtgctgggattacagatgtgagccactgttgctggcccgagttttttttttttgagatggagtctcattctattgccaggccggagtgcggtggcatgatctcggctcactgcaacctccgcctgccaggttccagcgattctcctgcctcaccctcccgagtagctgggactacaggcgcacactcccatgcccagctaatttttgtatttttactagagatggggtttcaccatgttggccaggatggtcttgatatcttgacctcgtgatctgcctgccttggcctcccaaagtgttgggattacaggcgtgaggcaccgtgctaggccaagagttttttatagaatttaatcaccaggctctccttcctccctcatgccccattcctggaggttagtagatggaactactaacagaaagttccaatcctttaattacttggtctttctgattatcagctccatcctgaggtgatctagagaccccaccctaagtctcctcatcagcataaattgaggtgtgttccaaaggggctctttatgaataacttgaaaatacttttattactcaggaaattctgaggattttggataggggctctgtgctagaaatctgacaaagaccaaatgtattattatactccttagcagaacatgtagggagaatcctgtggtgctatgtcttaaggagaaaagctgtggatatagtagaaatttggatcagagaaggtggagcaaagatttaatatcttttattttattctccagtgctaagccatgtgtaggcagccagtaaatacttgtgggctggatataagtctttttttcctttttttgtttaataggaaaggttgtcaatatagatacaaattcactgagatcctccatgaggcctggctttgaagatataatccgaaggtgtattcagagattttttagtctaaatgatgggcagtcatggtcccagaaacgtcactatcaagaaggtaaagaattttggggttgattgttcttatcattttattctttagagacagggccttgctatcttgcccaggctggactcgaactcctggatttaattgacccttctgcctcagcttctgagtagccaagactgcaggtgcacaccaccatacctggttttgtggttgattcttgatcttgtttgtcattatgtttggtatacacatgactgtagttgctctcttgttggtgaggggtaggaaaatgatgcctgagtgttcttattttaccctgttgatgattttggtgcagatccagtctttccttggatttttagaaatgtacttgaagtatatttcctccctgtcccctcctatatatatttgttttgctgactgtagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagaggtaatgatagattactgtgtattctaatacaaaatgcagcagtgttctcaaaatgctttattattaaagtaaaaagggaagggataaaatgagacaaaatttaggaaggttattgggtttgatgaaatgagtttagattcctggattatgatatgtttaaggttgtatttttatgtgaaagtgattatttattaaatactttacaggaaagctaggtgatgggaaggctaatgggtggataaaagagcacataaaatctgattacatgtcttaccactcatttctgataatgtgtgttgctttggggactgcatttaaaatttgagggtaaacttcaagaataaaggtagttactgtctgggttggtagtggcaaataagaaatgcatgaaggggaggatattcacccattaattatcttgagtaatttgcaggtacccccaggtgaagccctagataatgtggcaactctaataaagcccacctgaaactccagttaacatagctgttggtctttcataatactacagtggtctcactcatagattctgtggcttactgaaaaatatgttactaggtaaataattgatcaatatgtagattggaactgtcactaggtattggaatgctgcctaaaaagttaagttcctgggtagttaattcatcccatttttttattccctctccttctctctcccttcttcctttcttcttcttctcttcttctttttttttttttttttttttaaacagagacagagtcttgatctgtcacccaggcaggtgtgcagtagtgccatcacagctcactgcaacctcgaactcctgggctcaggcgatcctcccaccgcagcctcctgaatagctaggactagagatgtgtgtcactatgcctggccaatttttaaattttttgtagagacatgatcttgctgtgttgcccaggttggtttcaaactcctgagctcaagtgatcctcctgcctcagcttcccaaagtgctgggaatataggtgttagccactgtagctggctggttttttaaaattttattttattttaaatctgattaaaagctttcatgcatgcttagaattttttagtaaaagtttgatgtttgttttgcagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtatttgtgttgacatttccttttattttttttctttttaagtaattattctttccatactactataattcttgtaaagttaatctattttataatagaaactttgaagaattaagttgtattttgttacagtgtctggtagtctaattcttttcctaaattttttttcaaattcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagaggtaatttgttttctgtatatttcagctcatatttcatcatttttcggtgttagataatgtgatataaaaattcttccattttaggtttatttaaagaaagttaaatctttagctctcatttctttataattattttggatgtcagtaaaattatgatgtaatttagaaataacagatgtgtatgttttaagatgtgactataactctttagtagccaatatgaaattttttcatggaggtgtttattgctggaatgggcagattgggtcattaagagaatggtagaagtaatcaggaaaaaaaaaacttgtattaagcagcataatttttattttaaggtaaaatcaagtttcatgcacaagatgacattctgtataagcatttcccaaacttataggatatattaatatgcacttgagaaaatgaaaggcttaaagttaggatgtgggcttaacctactgttcaccaaatttattgaccgaagccctttttagagcatgcctatgaacatcccagcttgctccttttattattaatcacacttattttcagaaggtttgtgtagatgcagatatctgttagctaattatcaatgcactgctagtgactgttacctgcaaaatattctacagtttgagaattaaatgtcttgtgtaaatttaaaaaatgcccctttgaaaggaccaaatgtagtgatttaatctcagaggaggaagattagagatgggggtcataataaactggcctttcaggtgggtattatcattgtaggtagtttttgtattttacttgcttctatttcatgtatcattttttctgatgggtatgtttatacctgtgtgtctggtaatgtatacaggttaatttttaaaactttattttcagggatctggagacttggataatctagatgctattcttggtgatctgactagttctgacttttacaataattccatatcctcaaatggtagtcatctggggactaagcaacaggtgtttcaaggaactaattctctgggtaagaatgaactaggttttttttttttttgctgcctttgaaacttttctgcatacctgtaaacactcttacactaagaccaggatataaatagcatttataacttcagaacatatattctgcctctgttttctatactaatttatatgtgctttagaaagctttttgaacattttcctgttttttaaaaattaaataaatttcccacttctaactaatatgccagtaatcatggcacttatagaaaaatattcatgtttgattattccaggtgagtactgtaggtactagggcatatatttttcttagccacagagaactggattaaaaagcaactcagactctagattaaaacctgtccattggtgttttaacagaatcttgtcatttaattaagatagttttctttggtgtttgctggttcttatctagcccctctcctgttgctgtgtgttgacttcatcaatttaacaaaggtaggccgggcatggtggctcacacctgtggtcccagctactcgggaggctaaggcatgagaatcgcttgaacctgggaggcgaaggttgcagtgagccaagattgcgccactgcactccagcctgggtgacagagtgagactccgtctcaaacaaacagacagaaaaacaaagatatattgtgtgtgtcaattgaaaaggcagcatgcacaattattcagaatggtcattattcagtagcattatttcctaaactagaatggatagatcaattaagagtgggggggaaaaaaagaaggttagaaggggattttacattttatttcttttcgatcagaaggcaacttatctggttaagttgattgttaaaattataaacagtatacttaagtacaaatatgcaagaaccttcaggagcttggaacatttgtgaatttttcaatattaagtgaagcgcagagtatcagtgaccatatcaggctacagaaaagttctcagtacttcagccgacatggagattgttgtttctactttatttggaatatgagacccttttttggctggcaggggggcggggggtggcggtggtgggtgagggccacttccctcacttattttgtaaaggaagacagtgtttgtttttgtaagaaagacattcttgggtggggagtggtggtatttgtgttttgtacttgattatttatatattaaatcacgaagaaatgtttttgtattgtgttttcaacaggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtacgttatttctaattagtatgtatgattattttgggaaaagcatatttaaaatacttaaagccatctaaataattgggagtaaataataactttttgaataacgttagtatgtttcttccatgaatatccttcatttattctatgttttggttatgtaaactcttcaagagtcttttggtctatgacattttccagcctgttgaatatatgagaatagtggcctatgtctccacagttggccagcccttttcttaccatgacaaagtgctgttttgtcaaggttgatgttgtgtataatggctgtacttacatggtataagaaggatttcattataatatggaaaagacctaagtatggctacctgttttaggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgagtaagtgtccaccctcccctcttcatgaaaaaagaaagttagatgtttcaggataatttttgctcttatttgagaatttgtgctttctttttgctcccccagggcctggtgaaatccccatgggaatgggggctaatccctatggccaagcagcagcatctaaccaactgggttcctggcccgatggcatgttgtccatggaacaagtttctcatggcactcaaaataggtggggtgttattttgtgactctgtagaaaatctcagcattgggtagtttagaaaagagttggagcacagaagcaaacgtgaaagagaatgagaattccctataattgaggtactgggttgccagctgggcatttctcgtgtaactctgtgtaaaaatgaggctgaagcagtaagcagtgcgtgtggcattcacaggagagggaggagatacaaccatgttgtccagccattagggccattcagtggccaaacctctgagagcctctctgtgagatgattgtctctctagtcccatgaggaggggaaaaaagataagtacatgtttctagtggttttataaatgttcttcagagggttagcctcagttttccagaaaattaaacttttttaaaaaaacttttcttttcccccaaccacctgctgcctattgagaaaattcttttaaggattggctaattgttttctaaaattattttaaacatttcagtgatgatagtgaaataactatatagcatctttaaaatttttcataaaataaagattgtaggcccggtgtggtggctcacgcctgtaatcccagcactttgggaggccgaggcgggcagatcacaaggtcaggagatcgagactatcctggctaacaaggtgaaacccctgtctctactaaaaaaaaaaaaaaaaaaaaattagccgggtgtggtggtgtgtgcctgtagtcccagctactcaggaggctgaggaaggagaatggcgtgaacccgggtggcggagcttgcagtgagctgagattatgccactgcaccccagcctgggcaacagagtgagactccgtctctaaaaaaaaaaaaaattgtagattgtatttaatttttatttagcttagtaatttacttgcatgcaagaggccatggtcaatgtcagctctaacaggaattctacagtaagttaagcaaggaaaataaaaatgaactgatctattgagcagacagtgatgtaactatatgaatttatttgagtgcttctctactctatatgaatttatttgaatgcttctctactcaatagagagcaaatagtttcaagttaacagaacttttctgaggcaggataaatgtttaacttcatgcccttgtatgtgttggagaactgaggcaacttgctgtgggtgtatggggtttgtgttacacttgccaatatgagctctgtgggccaagtgtgacaaagtcattttggtatttctccagactcacgtcagtgatagctcaacatttctttttttttttttttttttttgagacggaatctggctctgtcgcccaggctggagtgcagtggtgcaatctcggctcaaggatctcctgggctcaagcaatctgcccacctctacctcccaaagttctgggattacaggtgtcagccaccacgcctggctcccttcttttttttttttttttttttttttttttgagacaaagtcttgctctctctcccagcctggagtgcagtggcgcaatctcggatcactgcaagctccgcctcctgggttcatgccattcccgcctcagcctcccgactagctggggctacaggcgctcaccaccacgcctggctgattttttgtatttttagtagagacggggtttcaccattcacaggatggtctcgatctcctgacctcgtgatccgcccgcctcggcctcccaaagtgctgggattacaggcttgagccactgcgcctggccatagctcaacatttgtatccttccttttattcttttgatttctctaattttcaagtattataattattacctccttcactgtttttgtgaggagtatcttctcccatccttccctaccctccccctggcccccatttctgctataccccaaatgcctagggtttggcaattacaatttggtgttgggattgggggtttaagctgtatatggtggtctaaagtggcctggtgaaatttctaaattgtgggccttaaacttaaattgatgccattcactcttttttaccacttggtttattatttgtgtttgtagcatttgagttactgttcattaaaaatactatgcatggttgctgtgatctattactcttagaaaaaaaaaaagcaccattgacattgattgcaagtctttttctaggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcaggtaggttgcattaacatggaagtaggagagtgtatatttgtgtgtgtgcgcgcgtacacattcatgaagccacatacaagaatgcctgtgtgtgtctctcctagtacttgtgttatatcactacattcatggataccagcattaaatttggaaaatatccttttttggtctcaattcgtatgttaaaatagaaaatatacttacgattgcgatattactttcaacaacccactatttttggcaattgtagaaatgatttagttaagctactgtactgttcttaaaaatgtgaccttttattcatgttaacagttctcatttttataactatctttctctactacttagccaagccgtgtgtattctgaggcaagctttttttttgcttgtttgtttaaacaaaacttgtttacaatggccaagctgaacatcctaacatcatggtgtcctgttcctgtttacataccccgccttatgaaaacatgccattcacaaatctgtatttctgaaagacacattctgtagtgactgttttttcttttttgaatcggagtctcgctctgtcaaccaggctggagtgcagtggcacaatttcatctcactgcaacctccacctccagggttcaagtgattctcctgccttagcctcgcgagtagctgtgattacaggcacccgccaccacgcccgggtaatttcttttgtatttttagtagagatgagattttgccatgttggccaggctggtctcaaacttctgacctcaagtgatccactcgccttggcctcccaaagtgctgggattacaggcgtgagccaccgtgcccagccatgactgtttttatttaaaggctatggaggggccactgtataggtttgtgcgttcaacagtaagcaggaaagatcatcaggggctgtcagttgttgttggggaaatagatgtgtacatatggaagtacactgccatgtggcaaatgctgtcacagtgcagatgggaaacgctgagcagtccttgtgtacaccttcagggataccagtgacatagaaccttggcactgaggagccatattttatactccaacagaagtatagaagttcttttttatttctttacttgttcaggcacactaaataacccatcaattccttccttccctcctgtagttctctctgttttactgtgtccttgtgaggcaagtctagaaattaataattgtcactattcccctgtgttggactcctagtatcctgaatctcaaatcgctttctgtcttgatttactcctttgttttgctgcaacacaacttctattaacttcttcatccctactgcatgaaataaaatgttttgggttctatgtgtctgaaaatatctttattccaccctcctacatgtctggctatgtattacattctaggtttaaaataattatatacttttgaaagatttctgccatagttttctggcatctagtgtggccactgagttgtatttctttctgattttgattcatttgcatgtgacccgtttattctctttggaatgatttaggaactttttctctccgaaattttatgatgctgtatcttggtatgggtcttttttcattcattctgctgtgtactagatacactgatattccctttggtttaggggtgttttcttgtataatttctttattaaccttatctctcctgtgtttttttttctgacctacttttctgggatttctgttgacatgttgggcattaaattcgttctatttttttttttttgagacggagtctcgctctgtcgcccaggctggagtgcagtggcgtgatcttggctcactgcaagctccacctcctgggttcaagccattctcctgcctcagcctcccgagtagctgggactacaggtgcccgccaccacacctggctaattttttgtatttttagtagagacggggtttcaccgtgttagcgaggatggtctcgatcccctgacctcatgatccacccacctcagcctcccaaagtgggattacaggctgggattacaggcgtgagccaccgcgcctggcccttcattctatattttgaagtcttctctatttttcttgtctttgatttgcttgagtcacgttcaagcttggaaagtgttggacgcttttatcaagtatctggtgatccctgactgttcttatatgttaagagtgagacattaagaagctgatttgacactttgcaagtgtgagcagcatcagttgtctttactgagggtaattaagtggggaactagccctagcccttttatttcaggactccccaaatttttatttatttatttttgagacggagtctctccctatcgcccaggctggagtgcagaagcgtgatctcggctcactgcaacctccacctcctgtgttcaagcgattctcctgcctcaacctcctgagtagctgggactacaggcgcacgccaccacgcccggcttttttttgtatttttagtaaagacggggtttcaccatattggccaggctggtctcgaactcctgacctcgtgatccacctgcctcggcctcccaaagtgctgagattacaggtgtgagccaccgcgcctggccaggactccccaaatttccacatgtagagttgttttcaaccaccactaccactcctgccatctggtaatcttttattacctggttgcattttgggagctgggctagggaggcaagtgtgggatattaaattataaaatataaaattttatttaaattataaatatgctaaatataaaatttcctgttttcagcctctgcctcactcctttcttaggctctgcttggtgcccctgaacccctgtacctttgtcgggtaggtagaaggtacaggcctttcgggagtcagggagcaggcagggaggtagttgacctcctgctctatactcagactcctaaccaacctcctcatttcagcaccatgctctgatcccctaccaccctcactggagtctcaatagatctgtggaatacatttgcttgtttttcatatgtatttttcctctgtgggcacataagtctaagtttttctgttctgttgagctggttcctacttctctattcactttgtatcttctattataaatatggaaatacttgatcttgttgcgttattagtgttttatggataaatactaccttttaagtattttttttttaaataaactggatacctcttagttccctttattgtcattttagtagggttagcaagtgaatgcaggtaagcatgcatgatcagtctgccatgtttaacttaaagtatagtttgctttattaagacatcttcagccaggcatgatggtgtgtgcctgtagtcccagctactggggaggctgaggtgggaggatcacatgaacccaagttgatgggacaaaatagaaacatagtttccagttactatggtaacagtccaagaggtgtcctgggaagggtcataagggtgaaatggaaagaagggagggatacatgatatgccctggaggaaaaattgacaggacttggtggtcacacgtgtttactcttggaaagggagaatgtgaagaatcaaattgctgggttttggttcctgggcagtgaatggtgatgctgtgtaccgtcaccatttgacatctgtgaggggttggtttcaggacccctgtggataccaaaatccatggatgctcaagtcccttatataaaacagtctagtatttgcatatagcctatgcacatcctcccacatagtttaaatcagctctacattacttataatacctaatacaatgtaaatgttatgtatattatatagttgttacactgtattgtttagggaattattataagaagaatgatgactgtgtgtattcagtcaggtacagctaccgtttccttcccctggaatgttttcagtcccctgttggttgaatccatgagtgtggaaccatggatatggagggccaactgtattgtgatatagtagggtaggttggaggagaacaagcctgcttggggggaagggctgttgggaatcatggtgtctgttttctgcctgttaagtttgagatacctgagacatcagggtgcggatgttaagtaggcatttccataaacaaaaccaaaagttcagagatgttttggctggagacaaaaatgtgatcattatcaccagcggatgagagcacctaagtagaaaatatatcaagagaaaataagagagcctaggactgaaccctgatgaacagttagcattcattcaaggaaaggccagagagatgggagaaaaatgagaagtgttgcgaagtacagtggggtgaagtatgcttcaagagagacatgtcaagcatgctggctgcatgcttggcattcagtgcctgtggatgagaaaataaaggtgaatgcacagtacacctggttcttgtcttagcacagcaggttgttctcttcttcagaatatcaacttttacttctttttctgtcacctgtgggatgttattttgaatgtatccttagcatgtagagaagtgatgcctggcacataacaagcatttacttaaatacttgttgaatgactggatgttttttgcactttctttagagcatttgacttctgttgctttcatagatgttcttcactgttcttttatgtgttgtgtttaagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcaggtaaccagtcatgtgttcttccctctggcttctccttctgttgttttcagactatgtttctcagtgttcttaccactggtgcaatctatccctgtcaactaaagaaattctttttgttttacttctgtgtaaggttttatttgtacaaatggctccttgttaaggagtagttttatgagaatattctattttacaggtaaaaagtaaaaaaatgtcaggaaggattgctcttggggaagaaaaatgttacttgatgactttgtagtcttaaaggtagataaggttttttttgaaaaaaatccttactgctaataaccaaatacttaaaccttcttgatttcagcatttttaatggaactcttctttctagatgttttataaaactagagttgtcttttaatattctaaaatatgacttctgtttaccctattgttttcttagtccccaagaaatgttttaaaattcaattgtttttattgtttatgtcttcaaaccatataagtagatgaatgcctgaggttttttttttgtttgtttgtttgttttgttttgtttttttttttttgaggtggagtcttgctctgtcgcccaggctggagtgcagtggcatgatcttggcttactgcaacctccaccttctgggttcaggtgattctcatgcctcagcctcccgagtagctggggagccacgcaagcccggctagtttttgtatttttagtagagacagggtttcaccatgttggccaggcccgtcttgaactcctgacctcaggtgatcctcctgccttgaccttccaaagtgctgggattacaggtgtgagccaccgtgtgcggccaaatgcctgagtttggaatccaaagagccagagactccattgcataaatattgttaaaagtcagtttaggtactcagaaaagctgtgttactgtattcattttactttctgccgtttcttcactaaaagtcatttagggaaagctaatggagtttattcagaattcctctgatcaacttaaaggtatttccccatgtgcccgaataatcccagagaaagcctgactataaatcttttgagtttctattgtgtgtgtgtatatatatataaaatttatttatttattattattttttctgatacagggtttcaggatggaatgcagtggtgcagtcacagcccactgcagcctcgacctcccaggctcaggtgatcattccacctcagcctcccaggtagctgggactacaggagtgtgccaccactcttggctaattttttgtagagatggggtttcttcatgttgcccagactgatctcagactcttgggctcaagtgatctgcccacctcagcctctcaaagtgctgggattacaggtgtgaagatattctttaagctgcaaaattgcactttacttttttttccccagtgccaaacagtagcccatcatatgctagccaaagacttttcaacattgacctttttgcagtgtgaaagtactggttcagtttagacgtgacttagccaggttattgtgtttggagatattacctcattggctggtgctgagggtctggaaagctgttttggcagactgacgtgctctgcttgcattctaaccaacttgtctcacctcagtttttgaatcagagccgacaggcacttgaattgaaaatggaaaaccctactgctggtggtgctgcggtgatgaggcctatgatgcagccccaggtgagctcccaggtgaggatgataagcctctccacatgcattgctctgtgctcaggacagggcttggcctgtggttggctctcagtaaatgtttgttaaacaaatgaaggtaattctgaatttcttgtgtaagaaagcagtcgcattaaagactttcgactcttccattcttctctctggctggtgactgggaggaatcagaggagggagagctttcttcattaaaaccatcgattagtgtttttttaattggttccctttgtgatcagttgctgtactgtgagaacagctatcacttggctgtttaggaatttaataaatctgtaaatgttcctctgttcctggattatgaaacaacatgcacactgggtaaaattctgaaattataaagaagaaaataaagaatacataatcctgttctcagtgatagcctctgagatgacctgtttcttgtagtaggaggggatattaaaattcccttctacttccagccagtggtggagacagtattgaggggtttttttaatgtgcatgaggcagatgaccacacagcaatcctctattgtgatttgaaatatcgtttataattgttttttaaaaagcaactgtgaaatgctcgatttttattgtcttatgcctacttggaagtactgatatttacattttcttgataataaaacatcttgtggaagctgagctagaatgtcctacagaaagatgataaaagcttgctttttggagatgacccgtagctagtagagctgaaatcagcttccttgttgtacttcagttatgtcaccttctgaacctccagatagcttctgcttgccccttacctctttctgaaagtttaaagaaagttcaagattttctgaggtggacccctgcttatctgagtataaccccatcttattttttttggcttcatgtttcagccctccaccaccccaacacactgaatcctcattttcctgtaattgtctttcatagttcctgaaaaatttgtcctcagattccacccctaaatgttttcttactttgtggaatgtttctagtcatgttaaagcttgacagtgtgttgtcttttgtcttttaaccccaaataattttcaggtccctcttcttcagttctccctccctccccttgcaatagccagaaagctttttttttttttttttgagagtcactgttgcccaggctggagtacagtggcacgatctcggctcactgcagcgtcaattccctgggtttaagggattttcctgcctcagcctcctgagtagctgggattacaggtgctcatcaccaaggctggctagttttggtatttttagtagagacagggtttcaccattttggccaggctggtctcgaactcctgacctcaagtgatccgcccaccttggcctcccaaagtgctgggattacaggcgtaagccactgcaccaggtcagaaagcttttatgtgaagaattgtatgttttggccggcacagtggctcacacctgtaatttaagcacttcgggaggccgaggtgggcggatcacctgaggttaggagtttgagaccagcctggctaacatggtgaagcactatctctactaaaaatacaaaaattagccagagtggtggtgcacgcctgtaatcccagctacttgggaggctgaggcagaagactcacttgaacctgggagacgaaggttgctgtgaggcgagattgtgccactgcgctccagcctgggcgacagagtgagaccctgttaaaaaaaagaaggccctgggtgttttctgtcttatacctggtgtattgtgggggtactatatgtatgcaactggcaggttcttgctatatatatgtaattgcactctttcttgggtattagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggtaaatctgacaatgaaaatgtgccttccccaagttaacattactaaggacataagcttcattacatttattgcacatgaaagacaaaaacacgattcactccctctttacttcacaaggaaaaccaaattaatttaaatgattggaaaacaaaaatgctgcagcacacaggtaattgagacaggtgtatcctgtcatagttgaatatttttttcagtcccactcattaagagtccccaaactctggaagaaacactgcaaagttgtccccttgccccttcttgtatgttccagtatagtagaactctctaatctctgaatgcttggtcaagtcagtgagaggaatgcactttgtgggcttttaagttgattttcttggtgacttggatttattattttttttttgagatgggggtcttgctctgtcacccaggttggagtgcagtggtgcgatcttggctcactgcaacctctgcctcccgggttcaagtgattctcctgcctcagccctgagtagctgggactacaggtgcattccaccacccccggctgtttttttttttaaatttttaatagagacggggtttcactgtgttagccaggatggtctcgatctcctgacctcgtgatctgcctgcatcggcctcccaaagtgctgggattacaggcgtgagtcaccgtgcccggccctggatttattattacagtgatgcagatacctcttcatttcagcctttgagaggttccaggaacatggtgggaataaaggtgtctattggggagccctgtcatctgaggattataactcccctgccctttaaagaaggatggagtgatgtgagttgagtgatacggagtcccttttctacaggaaacccattaaagcaactgatctttcagtgatccagatggtgctcctttctgtagtaagcctgttactctagtcgtcatcttggtgagaatctagaatacctgggggggcagcatcttatagcactctgtatcttacacttatcacttccctccacccccacctcctttaaaaaaaaaacaaaattactacagaaatctgatattctaaggagaaggcatttgggcatttttatttcttctgttttatttttgtaaggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacaggtaaagaacagtgacttataaagttagtcacatcctagtcccagaagtccaagaacttaatgtatttttcagtcaagcctttttggatggagaggttgaaaggactgggttcatattagaaggtgtgatttggcttgtccattttgagagtccttcaagcacgcacatatctattagggtgtctagtacagaaagctgtgaaaaatggatcacaggctgtcagggagttttctctaacattcccagcttaagtatagcaatgtttgacacaattgtagtaatttctgtgggcatgccctttgtcgctaaagtgacttccagaggtaatattaccatttgtttacttacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcaggtatgggatcgattccttacctttttcaaaaagtttttcttgttctctggatagaactaaagcctaggctataatcagaatgtcctaggtatattttaacttgaatgtataacttaaaatatagtaattgaaaaaacttggtttgaaggcattgggccattagatacttttggtaagccagagctgcattgtaagatgggatctcaggaacctgaatcactcagccagagctgcactgtaagccatgaatgtggacatgggtatttttttgttgtgcaaagcatgtgttttactcattttttttttttttttttttttcctggttgctgacagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaattggagcctaaagagttttttttttttttttttttttttaaatccctgttgggttaagggtaaaggaggttaaggaagcctatttcaaataatggtaacagtttctgagaagttaaaaaacgccactagggagttgctagggagccttggcctgtttggggcattgaaacaaatgtgggtgcttttagggattatctccgtcatctgttaaatgagaaatgggttggactggtgattgatagttgaaatctgtcaactacttgtatcaggttagactacctgatacacaaagaagggttggccaaggcgaatttctttgcaattgattaatacttttttaaaaaatgaagtaccaaagctggtatactatgagacttacctgtagtcccttgaagtatggtagactttttagtcaatctacaaccatctactccccttttaagaaaatcttctaaacccaaggcattttcttccaaaaagatgttgactggtagtatcttgaatactttaaaaaaacagacacaccaaaaaactcccaagaaatggccttttacaaaatgtcaaaggttcttcataccaactgctggtcattggctggggttttgaacactgtatgacaatacttaaactacaaaattttttttacaaatacagtttcatcaaaacttgggacatacatcaacttcatttcttttcagtaccttaaaaaaaaaacatcagttctgggacataacaaagaaatactaggagaaatggtatctggacaggaacagaaatgtccacaactgcgagggattttcttttacactggccacagagcgtttattgacaccaccactcctgaaaattgggatttcttattaggttcccctaaaagttcccatgttgattacatgtaaatagtcacatatatacaatgaaggcagtttcttcagaggcaaccagggtttatagtgctaggtaaatgtcatctcttttgtgctactgactcattgtcaaacgtctctgcactgttttcagcctctccacgttgcctctgtcctgcttcttagttccttctttgtgacaaaccaaaagaataagaggatttagaacaggactgcttttcccctatgatttaaaaattccaatgactttcgcccttgggagaaatttccaaggaaatctctctcgctcgctctctccgttttcctttgtgagcttctgggggagggttagtggtgactttttgatacgaaaaaatgcattttgtgcagctggtgaggtataatccaaagcaaaagcaggggcaaaaatggacttcctgaagttatctctgctcctgctggttatcctccagaatctgtcatgttgactgagagtgcgtgcttgctttctcaggcctcctggccaataccacaggtctgctggaaatcacccacatggtttttcattgcctgtgcagtcaggtgatgcctctatgtttttggaggtccacctctgttgtttcttaaccttcccagccttcccacagttgtcccctaaagaacaaaacaaactcatcttagcacttagctatcatggtctttatcatgacttcctaatcggtcctatagctgaggaagctttgcttcaaggctgctgagaatgaatatttctaggttacttagaacgggattgccaccacctagtcacctcaattttttgtttacttatacacccaatgcctggcaaggatggcatttaaggatctggacagaatagtggctaaggagattgtgatatgtaaagattctgtaccttaattctagaagcaccgaagaaaggcttaggtgacctgttactaatgtcctattaaagccacacaggtttatatgcatataaaggaagaaatgagtagaccagaggttgcaagtggcagttcaccaagggcgataatttgcccacatggttaacttaatgtcaaattagatgataatgataaagaattctcacacatacttgcatttttggatttggtagacgaatgagaaaatctggcgaacctcagcccattcctgcagggagcaaactggcctgctccctttagaatagaggtgaactttacaggttgccagtctcttagtccctgtcagcctccaatggcactggagtgagagtttgtagcatgggctttttggaaaccatttaatgaggccatcctactactgatgttgtatatcagttagcacttttgtagccacagccttcaagatgcctagcaatttgtaatatttaaatgcttctcaacctctaagtaatagctcaagtttaccaagcacagattatagcgagaacagcagtgtactggacaaggcattaatctaaaacatgaaatggattcaagtgttttcttagggaaagatgtgcattagtacttcccccccaccctcatcatgagaacaaacaaagggtggtatgtaagaaatggcatgcaaatagaatagcattggcaaaatgaagcggtcagaaccagatttctatttgtaagctggttcctcaactcacagtgatttggaagaaggtctcttcatttctggccactttcgacgctgaaactgcctaagttttcaagtgtcaaaggagaatgaatgttaaccatcaccaagaaagaaaaagtccccaaagaactatacaaagaaggtctcctaggtgacacctatctttggtgggtgatcctggtctcgggcagaccagagggaagggcagtttctcaagataacaggtgcagactcacagagatgagactgaaggatgggccaagataggagaactttgtttaggctttaataataaaacgaaatacctgtattgctcatagcttcctccatctttaagtcctaaatgaaggagaaatgaaaaacaaaacaggagcagatagtttaggcaaaacaaccccaacacaccagaaaaccatcttatgcttttttgtcacaatcccatgatgctgatagtgttccctactcagagtagactgaattatgaggggtagactgaattatgaggggaacctgccctaagtctcctagatagccttgtagattgcctaaaatccagtgtcaccatgatcagtttcaggaccctgatggcttcattcagcgctgaccttagttatggtgagggaggtagatgcaggcatgaacatctgtgctccagaggacagaaagccaagagccctgaccaagtgcaggagggagttcccctttgggctctggggaagttttcccgaggatgtggcaggatcaagtgcgtgggctccggggtcagcccaccttgttcaccttactcctccataaaatgaggataagattcacctcaaagcttatcagctaacacatgtaaaatgctcagcacagagcctggcacacagtgactaatatgtcattgcactttgatcacaagagtagcagcacttgagtggcagagattaggaagctactagtgaaaattctgatcatatcaggctcctgaccagaagtattagtgcaacatcttgtgtaaacacattagctcttccctcttcataactagagccgacggtagcgtctgaattcctcctaagctgtgtagccattttcctgacatgaactctaggcatcctcctagacacagtcccttccccaagggaccttaaataccaaaggttttttttaggccactctctctcactagtaagtgaacttcatttttcttttagctttgttttctttttttaatatattttttttatttttagagatggggcgacagctctgtctcccaggctggagtgcagtggtgctatcatagctcactgtaaccttgaactcctgggctcaagtctcctcccacctcagccttccaaagccctggaatcataggcatgagcaaccatgcctgtttagcttttttcatcttaaaatatctatctggttggcattctaaacttaaaactgcagattttgtcctgtcccaaacaaaactcaggatttacctgggactcctaatcccgcacctcccatcaccatgttgtctgggggcttcaccacctgaatctgaaatccatcatctttactgctcccacctctagtccaagccaccaccatttctccctggataactgggccatcttcgctgttttctcccataaagtcccattctccacctagcaaatgtcggtgcccaggttaaaaccctccattggcttcctgatacaccacaaatgaaatctaaactctaccgtggcctaggaagccccacacagggtggcccgatgccctcccgccactctccactggcctcagttgtgttggctgcaccccctgagctgctttctgctcctcacactttaagcttcctggagcgccagccctccacgttttctcagtggtcgattgcatcctacttttcaggactcagttcagaggtctgaccctggttttatttagcagtgcccttccccagtcacactggattctaccatccagttttaccctttccatacaagcaagaggcctcctgctgtggactgctcttcttaggacaacactggctccacacaagtcagcgaggatggggtcatctttagtcaacatggtttcaggtgtaagttctcaggaagtgtttgttgaatgcatgagtggacaaaagggaggacaatgaaatgagacggaattccgtgtgtttcctgggcagttggtgcaggtgttcctctctcaggaatcacagcttgttaaaggtcatctgcctgctatggacaggggctcccatgactcgtctggaactgtatcacctcccaaagcctggtgatttcaggctcattcttggggtagacaccacctcctgagtcccttcctttggttaccctgctgtccaagggccccacgttggggtgcctactcacccaggtccatgtttcgagtccgggggttacactgcttgtaacccttgcagctcctcagctccatgagctgtacgtgtagctggttgaggacatccctgtccagtgtgttcactgcattcatcagctggttgcaaaaaaggtagtctgtcaacaaggtaagtacagggactctcgccctgcccttctaccaaccaggggacatatttcaggcaggtggcgggtggaaggtgctaggggctggtgacctgtttactccaacttctgcaagagccagcgtttggaagagttaggtgactttttggcttcaagtcccaccaggttcactcttcatgagagtgaaaactcaggagaataaaaaccacgtctgtgtatttaacgttggagttctgcagccactggtcaggaaacttcccaagcttggaaagaaagccttccaagtcttggttttatcagcagccttcattcaggggccctcagctcctcctgattgcaaagcagccatttgatgaaaggacgggtaagtggcctgggttcttgtgtagtctgggagctaccggtgagggacttaacctacccctttggtaaagtatgagggtgaacctatctaaggagaaagactgcacacctatatagtaattaaagcatttgtgctgctgacatttaaacatcagatttcatttaaattatttcaggcttttcttgaaaggtcaaagcctgggcaataccaaggccacagtacaggaaagctctagtgctggagctcagtagtgactgtccctgtacaagggcccacatgttccgatgaccagacatgccactgctccttttggtcttgtgtggtcctgggccacttcagtcgcatgtgtgtttagatggcttactgtacggaagcacttagcagagtgcttggtgcagtgtgttactgttatattagctgcgcggtccgtgtaggccctgcagtgggtgatatttggcttgatcctacagcctgacagtgttaggagtcttcacaagttccggcaaaacctggttgcatgctgcatgttaagttagagggaagaagccatatatattacacacgcagggtgatggaggcaaaaagcagggtgatggaggcaaaaaaggctgattgaacacagaacccccaatctcagcagcttcacaacttactcccaccggctcagggactcagtgggacttggacaatttgtcatcacttccctgaggttggggggggcctacctggcagcactggtgtaccccacacccccatccctctagctcgggttgcctgtacctggtaggggtctgtgttgagatcaaagtactctaggaagccagttgcaaattcacagaagaggaaattgtgagtctcattgatggtcctcatgcaccagtacgtgttattgttggcgctggtgcaggcacagaaaggccccactgccaaggaagagagagcatgtcctgagtgcctgcgggaggaggccccatctgccaacagtgattcctgtcagggacagcccctaaaaccagttcgtcaaatgccaagaggctgtcccgagcaccgtggacccctggtgttggggaccccctttctgagagaggtctgggtcactaagtggagaagtttcttgaacccctgggcctcagcctgtccacccctgccctgggcttgctcacgtgtccagaaaggcgccgtctgccagtgctggttgtcgtgggtgaagcacgtgaggcctggcatgctgcacgtgtcgttgttctgcaggcgcttgagcagcttgcggagtttcttcttgcgcttctgctcccgcaacagccacaccttgtccttctcttgcaggcccttcctatgggcgcagagggccacacacaccttgggcctctgagggatcagtgaccccatgtctctgctcttcctgtccacctaagggcttcgctgaggcttctccaacagagagccatgggcatagcaattcagggtcccaagtcccagtgctgctccaaggcagagccgggaccagaacctgggtcttgtcattctactttaactcccaagggggcacaagctggggacagaaccaggcagctactgggactcctgttgacacccctttcccctccttcctgtgtcctgccctgcttggtggagttgcggtaaccccatttagccacaagggggcgtcggaggcccgctcagtgttgattgggaagtaaggcctcttcgagggctaccgtggacttcccagggaagggcctggacttctttccttttcttctgagttttagcttaagggagggccacctcctcatgcaggcctctgcatctcttccccaggacctcaagctgctcttacctgaaaggatgcagactggagcctctgtgcttgaggcggcctttgtgctgggtgtggtagctgtaacagacccccccagccccaggcttcaggagtggctcagagggctccgctggcaggtgcaagctgtgatttctgggactcccatgtgttgctgctgccccacccctgtccctccttctggggtggtggtgggtagggcatgaccctatcctcagggcagcaggtgcctgcctgagtggcttctttctccaagcatgagccaggactctgcctggacttttgctagactttagcaggttgggttaattgtaatttagccacgactagaagctgggcctggctttaggtgcatcagcctcagcatcctttttcctttcttttttgatggttaattttacatgtcaaagcctcagcatcttgaggttggttccctcaccaccctgcctactcacacttggtcggggtcaacacagggaagcctgtgttttgcaacactttctggaaagacagcagggcttctacagctgtgctgtccagtatggtagccactggccacaggtggctacttcaatttgaattaagcaaaataaaaaatttggctccttagtgacactagccaaaattttaagtatgcaccagccacgtgtggtgtagtgcagatatagcccatttccgtcagcacagaatgttctattagagctgttctagagttcagtcctttgggccaggggacccctaagccgggaacatggacctcaaaccacatgggggatttctgaaagggcaatcggcagaggcacttttccggcctggagccggctctgcgcagccagcacgggtctcttgctagcagtactggaatctgggcgccagcctggctgaggagcaggtccgtgtgccacactggctgacaacagggaggtaaattacggatttttttaatgccatgaggggagaagataaagataaaaataaaaaatgaaaggggtcaatcacgagaggggatgaactgaactgtcctgtaggagagtggggtcttagggaggtccctttgctactgcctcacctgattttgtgacagtcacattcttctggccgctttttcttcaggtgacctcggacttccctcaggttcttaattttgttctgcagggtttcaatctgagggaggggcagaagaggaggccttgaaaccttcaaggctggacaacaaagacttggcctggtgactgcccccacgctgccgtgtctgtgctcagcagcggcagcctgcactccccgggccccagggcaagcaccggcatgtctgggtggggaggaggtacttgttctgcctgaaggaagcccgccttctcctccagccagcccttgcaagggaaccgagtcatttttccggcctggcctgcgcaggaacccgctgagcccactgaggcctccagtgtctcccctgggtttgatgaaaggcctcctgtagcgtagacttcttgtaagtcaaaagggggacaacgtggctaagccatcgtccctcagacggcctgggcaggaagctatctgtctcatgctgggactgacacctatccccgcgttgaggaatctgtggggacctcacttcacctctccagcctcttccctgggtctggcctcactgccctcccactgtgaaccgggggtcctgccaggcccgtggtggccgagagcatgctcctctcccgctctccactcacctcgtggtcgatgtgcagcttgtggtctttccaggcctgcagggacttgtacaggtccaggtcacactggactgtgtcgttctctaggatgtagcacctgcttgagagaagggatcacgtgtggctcggaggtggtggagggggagcagcccaggtgcccaagaggtgtgggaagcccttgccgaggtctgtcctgtccccttcaccctcgacttccacctggacactcaccgatgtgtcactttaatggggttggcggctgaatagtcgggaaggcctccagtgccactgaagtccccaccatccttgtcatcttggtcctcaggggcccaagaggtgtgggaagccctttgccgaggtctgtcctgtccccttcaccctcgacttccacctggacactcaccgatgtgtcactttaatggggttggcggctgagtagtcgggaaggcctccagtgccactgaagtccccaccatccttgtcatcttggtcctcaggggcccctggccagtgccgcttggtgaggtttcggggctgggcggcatcacccaggcctacgtggtacaccctgccgtccacctcgatggccactgagcggatggagcgactgcggacatagctggccttgtactctgtgggcattagaggagtggcagagttagggaggcaggaaaggctggccaggctcccagggcagtgggtccttcatcaagatagggccgggcttccaagcatgaggctcagctttgcctgcgactcgaggggtcgtggaatctacccgcctgctcgcagatcctggaccgcaggggagggcctcgaggtgatcacaccggcaagacggaagtcctggagccaagaagccactgactcaagaggatttcaagcgagagctgcttgcgggtaaacaaatggcggtacatcatctgtacaacggaatatgcgaccagaaccaggagcgaggttctgattcacgctagagcgtggatgaatgtcaaaagcaggcggagtgaaaccagccagacacaaagcgggctcgtattgttacattctatttataggaactacccagaataggtaaatctatagcggcagaaagaagattggtgattgccaggggctgggggagagggtagtgaggagtgactgctttgtgggtacggggttcccttttggggtgatgaaatgttttggaactaggtagaggtgtgcaacactgtgaacctattaaatgcctctgcattgtatataattgtaaaaatggtgagtttgatgttatctgaacttcacctcaattaaaaaggaaaaaaagtatcatggatgtaaaaatgttgatttaaactgggaaaaaggggccctgcagtgcctgtctctgggtagaaatggacggggactggggaagccacttagcttctttgagtcccagagagctggaggctgcccaccaggtggtaggcaggtgctacacccaggtgggccggcaacaaggctgaggggggcttttgcatacgccctgacgctgaaaactcaggggtgcaggctgaagtgacaccccaggtagcctgtatcttctatgtctcaaaaacaaatctgagttggtaacattaaagaaaaaggggaggtggtggcggtgatgtagggatccagatttccagcttccagaaaggaaacagatgtctcacgggcccacagttccatatggtcaggacgggccggggatgggcggcccctttggctgcccactgtcttccctgttggccacagcccccgccactccttcctgttttaaaacctctgcccacctgacacatgtctggccccagcaggcacgcactgcagttgtcatccttctccagatgtgcctcatttaaagagaagggcctggagccagttagtgacccaggttttgttggatcccaagtgaccccgagatggtgaccaaagaggaccagctggaggcaggtggtggcggaaggcagtggaaggagggaggaaagggctcccttctcacgtggcccgggtgccacccccactcttgggggatgttttgtatctttcagttctcagacaccttgcatcagagtcacaagggccgaaggatcctgaggggccgggaaaggcctcccctctccagcagagccttgggccttttctgacacagggcagccttctcctgggcacttctctccctcggtttagtctcccgatgcaagtacacaaattgccgaggatggtccctgtgccaagcaggtcctgccccgagaggctcaggaaatagacccagcgtgtcctctccactccttttgtctcagtcggctcataagtgagctgctttgcctctttccaccctccatctcccagctctagattcaggggtccctaaaccatggcctaagggcccaggccagcctccatctgtctttgtgaatacagtttcactgggtacagctgctcgcattcccttatacctctgcagtcgcagggctgagttgcaaagcccaagacctttactctctggctcttcacagaagcggtatgccagccctgtgtgaatcctttcctggactgaagccacactacctgctctccccatcactctgtgttcatgtccagagtcctggaggtacccttcctgccacaccaacagggaatgggacaggacttcataacccggcggccaagagctttgactctgcaatcagatggctcaggtgcaaacccctgagcacatgtgtggccccggcgatttgggtaacttctcaggatggtgcctaccctacaaaggctccttggaggatggcacgaaacggaactagtgaagcattcatgcctgatgagctggtgtggaccagctactgcagggggtggggactctgcctgcagctgacgtcctcacctaaggtgacaaccctgggcccactccctgcctctccacgccggtgaccgcctgtgtgatgtggctgcccatgcccatggtgcttctcaccaccctcggccacaccggtcacctctctgtgactgggactcaccgccctgattctgagcacagggtctttgtactccatcttcctcctcctcagaacacttgctctctggctggtcacaagacctgctcctttctgtactttgttctcattaaatgtccattgagcgccattctggagccgccacccctctctgctagtcccgccaccgctgcgtctccttcatgcgtttttcaccagcggaagtggccctttgttcacttgttcacatcttgtttcatccatgaggtccaagtccgtgtctctccaggtcaactctaatctcagtgtcttgcacaaagttcaagaaatgaatgaaccccagtcagctgggcccatcccccgagtcctcgtccccttctcctgttcctgggtcccccttctgctgtgagctggctggctctgcctaacctccccacgccacagccaggatccccgtggatcaaggtgggccagggcttcccaaccttaccactgcggacactttggggtcagatcaaactctgtggtgggggccgtcctgtgcgttgcaagatgttttgccgcatccatagcctctgctcactagacgccagcagcacccctccatcacacacaattgtgacagccaaaactgtctccaaacattgccaagtgtcccctgggggacagaaagcccccagttcagcctgctctaggctgactgctcagaaaagagggacagagtgtcttgtcggagactctagcagggggaagaatgccaggcaggagatggggctggagtccccaaatcagccacgtgacccagtctttcctgtccatcatcccctgatgatcacccctgccctgctcacagggctgttgagaggtgcaggtcccggctctgacattacactcacatgaggattctgaccagggctgagctgactctcagctacttttaggtatttttctttcctctaagcattaataaggggaaaagagctgaatttctccctgccagatcttgtattatttaaagattatcgactgtgccacatattgaagcaaggagatgctggctgtgtaatccaatctggaaaccaatcattctgttcagctagaaaagttaatgtagtagttcctaatcagctggtgaggaaatgtaacggagggtcatcagctgggaaacggtgtttcaggcagtggctgggctgttatggagagagacttatctgctccacgatgaagacatttgctgcctggctggctggaccagaggagatcactgcgcctgccgtcagagacctcaatctctaactagtctgtggtacaatatcatccgtcttataaagaatggagactttttgttttttttgagacagtcttgctctgtcacccaggctggagtgaagtggcatgatctcagttcactgcaacctcccgctcccaggttcaagccattctagtgcctcagcctcctgagtagcagggactacaggcgcccaccaccatgcctggctaatttttgtatttttagtagacacgggtttcaccttgttggccagactggtctcgaacttctgagctcaggcaatccgcctgccttggcctcccgaaatgctgggattacaggcgtgagccactgtgcccgatcaggaaggagattccaacacaggctaccatgtggatgaacccggagaacattatgcgaagagaaataagccagccacagaaggacaaatactgtacaattccacttacatgaggcccctaaagcagtcaagctcatagagaagaagagtggttgctgagaacgggtgggagaatggggtgacagcagggtgggagagcggggtgggagaacggggtgggggtgggagcggggtgggagaatggggagataacgttgaatggggacagttgtagttttgcaagatgaagagttcatttagcagataggttgcgtactagtgggaatatagttgacactactggatacttaaaaatggttaagatgataaattttatgggaatttcaccataattttttttaaaaacaacacctaaaatctctcattaggctttggctgtccttaggccagagaaatgggctacgtgggaagctgcccagccttggagggcacacttctagccggcggaccccgacgcctccacacattttcagggcacaggctcattcttgttttaaagtcatgcagggaccattcttcctgtttgatggtgggagctgagcctcagaatggtgaagcgatggcccagggtggcggctgagccttctggctgggtctagaagagtccctctctccacttcgcctgctccctggcttctgtctgactgtcctctcctcggcccttgccgagaatgaggtgtgaaggtgtagacacttcttcagctgagtgaggcttttccccactcaactatagtctatttttgttcttcagggtagtttattttttattttttttgagaccgagtctcactctgtcgcccaggctggagcacaatggcgtgatctcagctatctgcaacctctgctcccgggttcaagcgactctgctgccacaccacacgcccaactaattttttgtatttttagtagagatggggtttcaccatgttggccaggctggtcttgaactcctgacctcaagtgatctgtccacctcggcctctcaaagtgctgggattacaggtgtgagccaccgcgcccagcccagggtagttctataaactcaccacaaacactgactaattgaacgctgaaacatggctcctaggggaagcacagagctgggttcctgtgaacctctggtcctagcattttcaccagccaatcaatacagaaccttgtatgtgtgtttcttccttttttttgagatggatctcgctctgttgcccaggctggagtgcagtggcacaatctcgggtcactgcagcctctgcctcctgggttcaagcgattctcatgcctcagcctcccaagtagctgggattacaagcgtgagccaccacatctggctaattgttgtatttttagacggggttttaccatgttggccaggctggtctggagctcctgacctcaggtgatctgcctgcctcggactcccaaagtactgggattacaggcgtgagccattgcgcctggccttatctgtttattactactgctccccactagaatgggtggctcgtgaggagatgtggctgtgtccccagcccctagatcaccacctggcaaagtgacagtctctgtggaactgtcggagtgaatgaatggggccccccaggcatggtctctctcctcctgtcccactcagccaggttgtgacacttactcttcttgaagagttttttccggcgtccggccaggctgagcttgtagtccccgctgtcacaggtgcaggcctcgctgccctgcccgtagtacttgggcacgaggttggagagggctctgctgccgcccagccgcatggggcccttgcacttatgcagcttcagcttccccgtggcgtcctccacacactgccacttctgaaagacatgccagggcctcggccagctgctcatctgctcccctaaacccgcctctcccctgccacccccatccaccctggagacatccctctccctgcttgcatccagctgttaccgagccccacctctgctatctccaatgccgcttctctccactgccactgcttgaaccttgggcagagctaccatcatcccccagcgagatgcctccgacagccaccactctcacggttacctgcttctgtctgctcctaaaatccacccacatggcagctagaggaatctttttaaagggcaagttggatcatattactctcctacttaaaacccttcaatggctcccactgtctttaagacaagacccaagctcctgatactagtctttgaacatcctctgcaatctggccctggcctacccatcggtcctcctctccctcagccctctctccagtatcccctgtgggctgctgccccagggacttggcgctcactgttccttctgcctagaatgccttttctccagcccttcctgctgctggaggcttctcttccttcccgtctgctccagcgcaaggaggtctcccctgaccaccttcccagactcaatcagtgcagtgtgtgcagaggctccacgtgtgcactcaactccaggcctgtggtcagacgctgaatgtagatagaatcactgtccaaatctctcgtgttgatccttctgctcttccccagttccagcctcctggatcccctcacgggattctgcaaccacctgtaaactggattctcttcccttctgtccacagctgctccagcccattgacccagtgactctttagggcctattctgtgccaaagtgacctttccaggccatgggtcagatctgttccctgtgtctctccagcacttagcatgtgccaagcactgtgtgttaatatattaacttgcttactacacctcacgctaccctacgaggcaggtgctgtcattactgtgccgattcaagatgaggcacacggaggtagagagatgtgtcctgggtcacacaactgggaggtgcaagagctgtaaggaaaagtgtggagtctggtgccaccatcccccccaaccctctgctgcaccgtctgcccccgcccgctgccgttgaaggccctggtgcctttcacctgctcatcttgcccctgtcccgcccatctgttctcacctggaggctgaatctaattgcattcacagcgccctgccaccctcccatccccttcaatgcatgcaggcccttccagcaacctggattccttagtgcagaagtagactgatgggccagcaggcatggccctgaatgaggccagcccagaagcgcctgggggacctggggaggctaaagtgggcactgtgaccggctatacccatctgactgtcgccagaggggagcacaggcccagaagcccaggtctgatttttcaagaaaagccagggctctgagttctgcgtgaagccctgagctgtgtgcgctggcgagcagcctcctgtccacttagctctctctgcctggaattctccttccccactgcctgctccccgctccaacccaacaaactcagctggggcacgacttgaggggtcggcaaacagcagccctcttgctagtcaactccagcccacagcctgtttttgtatggcctgcaaaccaaggacggtttttacattgtacgttttcagagttgtaaaaagcaagaacaaaaacaaatatgtggcctgcaaagcccaaactatttactgtctgatcttgtgcggaaagggtttgctgcccctgcaactactcatgtagaagccgtgtccacatggcccgtcccgaggctgtcctggcgggggcggcgcctgagccccacagggctgggccagtgtcggcttgacttggggtccctacagctgctgagaacgaaggtcccgcagcccaactacctgggttcaaatcctgcctccaccacttgaagctgtgaggctgtgggcagtttgcctgagccctgggcctcagtttccccgtgtacagaacatacctgccagatagggtggctggaggtagagcttacactcacgtgttgcccgtgatgatcatcattacgaggtgcccagggcacatttactcctgcccggcctgggccctggtctgggctttggcaatgatgacatgaattctagccgggccctgcccttaggatgtccccgtgtcaccgggagacagacagatgcacatgagctcggttcctgggcacgtttgttcagcaaatgacaaaaaaacatctaccacgtggggtagcacggacaaggtacccaagacaatgctatggctgggtgtgaggcccctaagagacgtcctcgggccacagggtacagcttctacactgggcagggcattccagaaggcacggcacaagcagggacatggcaacggcactcggggagtaccggcttgtgagcagggccgttgcctgggatggggggcagacgtctgagcctgaggtccccaaagctccggggctgggtcgggggccgtgggttgctgcctcccagctggcctaggctaagtgccccaaactccgccctcagcactctcttcctttggcttcagtggtgtgctctgattgtttggaaaatgctgatacctcctctttcttggccccagcaaagaggtcattctggctgcccaagccctgatctgggtcaggggagacatcagaaagaaccagtgggggacttgacaacgttccctcgtcgaggggcaaagacttcctggcctcctcatttcactccttttagcccagaactaaaatcagaaccacttctgggatctcggtacaaagtcaaggctgaactctctccagaacatcagctctgggagggcaggagcttctgttgagcatgttcgaggctgtggccctgcgcctaggacagtgcctggcaagcggggggacgcattcatgctgtacaacggagggatgaaatccacagctcctgcccggtggcagatacgggttaattgtgtgactaagaggggtctgtgggtttacaaacacacactgggtggggaggcacagtcaggcctgtatgggcctgtactaattctgtgtgcagtgttaagatggagtcattcaaatgcagtccatcagaaacgcatccacttcaggccttggccttcaataccagggccctggttttgctttttctcataggtgaaacaggcacacagctccagccccagctcaaagtcccagcctttgacaggcagggcagggacacacctccggcaccccttgggccagccaaggcagagtttccatcccactcccctccctgccctgccccgcccccgaccctcctctccaagcctgccctggctttccagcctcagaaaagcctccttcaggctttcccaaacatgtcagtttctggctatctctgatacttcccagataattttcttttttcttatgtttttagagacagggtcttattctgtcacccaagctggagtgcagtggcgcaatcatagctcactgcagcctccaacacgtgggctcaagccatcctcccgcctcagctctggagtagctgggacctcaggcatgagccacggactgttcctggccataatttccttaatatttctcttgcaatcaattcactttttaaaaccttacctatatttattttaaaaagccatgtcttattactcctataaaaggaaaaccagtcacaaagaggatactgtcaaagtgaatatggtgaaaataaaataatttaactcctgctggggccttcgtgcaagagagatcggcaagggctagagaggcgctaagggcatacacacacccacgggacacttggcctctgacacggtcagggtccaaaggctgctgagaaatgaatcacttattgtgagcatcatcctgcaccaccaaacagcatcttgggcaccacacggcagcaaaggactacccgttgggaggccctggccctgctggctcagcggctctcagagcctcgcaggtcagggccggctgcagtcaggagggggagccgttgggagggaagggagccttcttacctgtcccagctgctcacacgccgtctggtactcagcacgctgacacaggtccttcacacgctggtacttgggcagaaagttctcctcctgggcgtccaccttgtcattgtctctcttgtgtagcagcttgctatggggcagagagcaggagccgcggggccggcctctcagctctggaggagccccggaggcatgtgtgcccacctagaggggtgccccctcggctccggcttttcctcacagtggagggcgcagggccacctgcccgggtcttctgatgtttaggaaacttaagacattggaattttataagaaacttcccaaattgcatgagttggcaataaattaaataaattgaagacattgtagaggctggacaaagcatgccaaaagcgtacacgtgacctcagaccccaattctgtgtctataggagcagtgaatgggctttgtgtttaggggcctttggaccaacttcagagccatgggcagctcctgaatagcatgatgcggtggggctacagaagcttcctgggcagagggagggaggtgggcaggggtgtccctcccaggacccggcactcaccctctctccaccaagaaggagtcccgccagaccctcatcttctttttcaagtgaaacctggaaaaaagcacggctcctgcttctcagcaacatgagggcttcccacgaccccccgttcccccaggagcagggacggcaccaggagtcagccttggtttacggtcagcctggacagcaattgtggtgagtgtgcccagctgggcactagagcattgcccaccctcctctgagttgagccaccccttccccagagacttgggtctggagacacacacagtagaaatgacccaggtcaaaatcactgtaagtcccacccaagtaactgtgtgtgtgtgtgtgtgtgtgtgtgtgtgcgcgcacacacatctcaagcccctcccaggaagcccagcaactcccccggcactagacgagctctatctcgagttcagcgtcaggcgcagtggttcagcatcaggcgcagtggtttggcgtcttgagctctgtcttgagctcagtgtcaggcgcagtggttgccttgatgtcaggttaattgcattgggttttgggagtattttcttctttggtgctttgcagttgcatgtatgtaatttgtatgtttcatccagtgccacctggtcatttccatttcctagatggggactctgaagctgagaggggaagcttccaccctgtcccctgacccccaggtgtcctggctcccaggccagtgtccccaaacatgtccattttataccattacagcttgcctggcctcacagtcaggggaggagcctcaatggacacggtccccctacagggcagccagatgtgggcacacagtgctcgcctggctggagcctctgggaggccacaggggaagggctccgctgccagaggtgcaagccaggagttgaagtagcacctggaggccaggaacctggtggctgttaagagcgctggccaccagatgtcgctgcggccacaccagcctccccgccctgactcagcccacctcccacctgtctgacttgctcaccctcacggttcctattctgcctctctggacacctaggaatatgttcccatcacaccctccagcattaaagttatggggcgtggtgagtcagcatctgaattcccagagctacatccagacttgctgggatacctccgacacgtcactcaatcgctttgggattcagattccaaactggtaaaatggggatgatgataatgtccacctcgctgggttactgtgaggatcaaattcctagatttccctgcacagtacttagaatagggcctcacacacaagcgccgtgcagttagcaccatctcctaccatcactgctgctatcatttcaagctttgggtaattttagctcagagaaggtccccaactggtcaccttggccacattccagatgggaagacagaatctcggagaggggaccatgcttctctcccacagcaggtaagtggttggcatggcgggacctgagaaccccagctcccgacccttggagaccccacgttctagacccacagggttttgctctgagttcccgcaggtcaatgtcccggccccctcaacacctgccctgctccgtcctcaccgattcaccggccgctccgtgtccagcagcttgaggatggatttcccgtccatatccgcaggtatgtccaggcctgcaatgtccaggatggtgggggccaggtcaatgttgaggacgatgtggggattcctgggggaggcaggagatcggggactcagtcactcaggtggtggtgcctcagcctcgcgtggggggtggggagcggtaggtgggcagcagtttgtgggaggctgacatctgcaggtatggaagctgcagtctggcacctcaacctcagcagctcccctctgcggcccagattcagctgaacccccactctgtgctcgcccccccttagtttctgtgtctcagctcatgccgtgagctgacagcctcaccctgtccccctcctgcccttcctgtccccacttcctgagtgaaggcgaccccccctttacagccagcccaaatcctggcccttcctgaacccttcccctgaacctctggggcagacactggctcctcgctgttccttgacagcccaggcacagtgcagcctcagggccttcttctttaccatcctctctgcctggaatgtcctttccctggagatcaggggccaccgtccctcacccctttagttctttgctctatgaccaaggaggcccgtgacaggcctcagtggtccccagaatccctgtccctggtgatcacaccttaatgtgaccccctcaccttgggtgtggaccaacctgcacctgctgccaaccagtgggttgtgaaggtgatgggctgtcactcccgtggttgtgttatgagatagtcaactactatcctgctagcagtctggctctggtttctttctccccttgctggctttgaagaagcaagccactctaaatcagcagctagactgtgagcagtctgggaggcagactgcatgggttcaagtcctctgcttgcacttgacctgccccatgagcagggacgcagatgctccccagtcaagcctctggatgagaccacagccctggccggcaccttgatttcagcctaagcagacgaccctgcagggctaggcccaggcttctgaccctcagacactgtgagtttgtacatgtgtgttgtcttaagctgctgagtttgtggcagtttgttctgcagcacagatacccaacacaaggcccctcctgaggaccctattcggaactgcgccccctccccaccctccctgctttatctttctcctgaagacttatcaccatctcatatgctatataatttacttatttctctggcttattgtctattgcccagttagactctaagctgcaggaaggctggctcaggtggtcacttctgtatctccaggacttatacccttagaacacagaggagctactcagtaaatattggctaagtgaattcccatacatctgccacctttcctggctcctgtttctttttttgagaggtgtcttgctctgtcacccaggatgcagtgtggtggcatgatcctggctcactgcaacctccacctcctgggttcaagcgattctcatgcctcagcctcccgagtagctgggattacaggcatgcgccatcacacccataatttttgtacttttagtagaggtggggtttcaccatgttggccaggctactcttgaactcctgacctcaggtgatacatccgcctcagcctcccaaagtgctgggattacaggcatgagccacctctcctggctcttgtttctggctgatggcattcccaatgtagggtaagggacttaaggggtgtgcccagcacaggacccaggacctgttgaatggtggacagtcccgtcagagcatctgagtgccttccccgctagttccctggggaccagggcagggcctgggtcctagggtttccgtcatctttaacccctcatctctccccagtccagtgccctgtgaacgtcgggcaggctgccaagcatgtgtgcagctgctgaagatggggctgtgtcatggggggctcgaaggccagcgtgaggcgctacaactgaatccagaggcgagggagctgggaagactgctgagcgacgggcgctctgcagaacccagcaaccggcagctaatggggctgagcttgtccagtggtcccgctcccccaggctcaggggaaggaggacagtggttgcttttcctggccagcaccaatgccttgctctgtgtcacagcttctaattctgtaggaactacctggccccattcagagtcccctgcccaatgtactcagcctggttactcaagggtttctgtcacctctggctacagtgaatggttcagggaaggacacgtgacctaagtcaggccagtgggagtcagcctcaggtcttctgttcaaagcagtttggcttcctaaacaggatggctgaaaatctggagctgctgaccctgccacaaggagaaaaacccacctgagaatgaagccaattcggcggaagtgggactgagagataagaaatgagagctttccaatggcattgtaagactgctggatccagccatgcctgaggctggagctgtgcatggacttttcagtaactatagttactgtgttccttttatcttacatgccttatctggttcaaaggtcatttctgcttgcaaccaaaggagtcctggctgacagataccgtgtgtctttggtcccaaacctgacatgagcactctctttttcttgaccatgtgggatgtggttttgggccctatgagtcagatcacagattccgaggctgaccaaacccccaatgtcagtgtttgtagagccctcagtgggtcagattctttctgttcacagggatggtttgaagtttctgagaggcgtggcagatgggaatagagactgcctggtttcaagccccagccccttcccttacttgctgtaaactcaggcaacttaacctctccgtgcctcagtggccttgggtgtaaaatggggctactatgagcatccacgtcacagggcagttgtgatgctgaaacgaattattaattgtttttgagatggagtctcactgtgtcgcccagacgagtgcagtggcatgatctcggctcactgcaacctccacctcccaggttcaagcgattctcctgcctcagcctcctgagtgctgggattacaggtgtacgccaccatgtccagctaatctttgtatttttagtagaggcagggtttcaccatgttggccaggctggtcttgaactcctgacctcaaatgatctgcccacctgggcctcccaaagtgctgggattacaggcatgagccacagggcccggcttgcaatgaattattatgtagttcttagaccaggccctgaagagtagacactccatacgtgtggactgtcgttattacagctcttagtccaatggggacgctaagagccaaagacgggcgtgatctgataaggtcaacagtcagtcatcactttctctggccttgaactcatgcagcctgcctcctggaattctcgcaaaatgtccaaggcagtgggaacatgtcagtctggaattccacactgcactgtcaacgccttttcaggaggaattccgcagccagccctgtgtgagtgctgggtgtgtgttcccacatctgggcatgagcagaaggcagaccaaatgacagtcttaatagcaacacatctgcttttcaaaaacctcatttgagccagcctccataatatcccagccgatccaaggaagctgctgccgggaacagtggcctgtccgctcccctgccccagacgcagcatgttcgctgccagaacatgtcaactcaaaggttagcccgaggagaatggctggctgagggctgcggcccacgtggtcctccaggaaggatgggagggaagagcatttccctttgtgctgctgcccagagttggctcagctgatcccagctgacaaccagctgcctgtgctgtggtccggggttcctccctgacaacctccaggctcaaagactgcccagcccagaacagaaatccaagcaccattcccacccgctggtgacatgcatgtgcgcgcacacacgtatacagcccagctccctggatttcctggcatacggccccaccacacctgtttccacaggtgctaacagctcccggcctctccttccccagcagagggatataacatgcatgacataattgctttccgctggccctggggtacatctgcgaaaactgtgtgccacccagggtgggcttgggtttgggctgcatggttgaagccctgagctgggcccaggggcctccctgggtccctgggggatgacacacttacagacagccggcttccacgttggggcccctcacgtagaacgggaccctgatgtcaaactcatatggcatggatttccctttcaccaggccaaactggccgatgtggtaaccgtggtcggcggtgtatacgatgtacgtgttgtccagctcgcccgtctcaaccagcatgttgtaaatctgcaacacgggcgaggaggcaagggacagtggggactgggtgcctggcccgtctccgacccggggtgacaggcgcttgagatctcaggccccgtccctcccctgcttcaggtctttgctcaactttcccaggggctgtcccctttgtcactgcaccttcctgcctcttgtcacccctggcccgccctcccctccacggttcttcatggcccttcttggcatccatctcttttacttatctgtggatcatctgtgtccctgccttggcatgctgcctccattagggcagacacttttgtcattttgttccctgcctgctgtatcccacgtacactggcactcaataatgctgtcaggtgaatgaatgaatgagtgaaacttgggctgcagcctatggcaggatcttgcgatctggaagggcgccgtgtggcagaactttctgcattggtggccgtgttaatgtctgcactgtccgatatggacacatattggctccagccacacgaacctactgagcatgtgaaatgaggcttgtgtgacagaagaactgactttataatgttactgcattcagtttaaatagccatggctaaataaaatgtgacaatacccatacaatgcgatattattcagcaataacagggaatgagggggactgattcatgcgacaccaggggtgaagcttgaacacgtggcgctaagtgaaagaaaggcgctgggcacagaaggccacagcgtgtacgattccatttataggaagtgtgcagaacaccaaatctatagagacagaaagagatcaccagttgtctggggctgggggtgagggagatttagtgggccatctaagggctgtgaggtttctctttggggtaagaaaaatgtcctaacatggatgtggtgatggttatacaactctgggcatattaaaaccacagaattgcacactttaattgggggaattgtatggtatgtgaattacatcccaataaatgtgttcaaaaatgtaaatagcaggaaaaaatataactagcatatatggttaccgtattgggcaacacagatctagaaaatgtttcatgaaggaagaggcttttgtctggattgctccaagctgttccccaggtctagcacatggggcctcttcattctgcctttgatttctattcctccaggaaaaccctgaagggccaggaggtctcggccctggcctggctgggggttcggagccacgcccaccaagaggcatgcagcgggcgcctaccgtctccatggagtcgtccaccgacatgagggtctgcaagcgcttccgctggagcatgttggtgaattccatgtggatgggcttcatgggccccgtgtagcgcatgatccagtgtttgtccgggttgggcgcgtagttgtagctcggcgtgctggtgggcaaggacatacacatcggtcaaacccagggacagcctggaccctgcctggcccccgccagacccgcccggatgagcagccaccctgtgctgtgtctgcagcccagggccaggtgtgatctcctggtgggaaaggggacattggcatgtcaggggcttatccaaaccctgtttcagcgtttctccacgtgtgaagtgtgcacttgggaagctcctaagaggcacagcattcagtgaccttgagtgacaaagtgagacagccagtcccttgtcggctctctcagggcaaagtctgtttggtgctagtgtttctttaacacctctctagactttgctcgtcttccttttgaaaaaagggaagaaagtcaagttcagagccttcatcgggaaccagtacccaactcaaattccatagcattgctttgtgtgccttgtacctattattggtagatggcagttacctttggtgaatggcaggtggcagttattgtggttaaggtaggaccacggaatatccttttgcaatagattttagtttgaaataatagaaatggatttaaaaatgaaataagtcatagttttatgtgtaaggccagaattgtgaggaaggcacctgaatgtgcacatttgggacatgccacattcttttttattttttgagacagtctcgctctgtcgctcaggctggagtgcaggggcgcaatctcagctcactgcaacctccacctcccagtatgagtgattctcccgcctcagcctcccaagtagctgggactacaggcgcgtgccaccacacctggctaatttttttgtatttttagtagaaatggggtttcaccatgttagccaggatggtctcgatctcctgacctcgtcatctgcccaccttggcctcccaaagtgttgggattacaggcatgagccactgcacctggcctctttgttttgagatggagtcttgctgtggtccaggctggagtgcagtggtgggatctcagctcactgcagcctttgcctcctgggttcaagtgattctcctgcctcagcctctttagtagctgggactacgggcttgtgtcaacacacctggctaattcttgtagttttagtagagatggggttttgccatgttggccaggctggtcttgaactcctgacctcaggtgatccacccaccttggcctcccaaagttttggcattacaagcatgagccactgcacctggcatgctgcttaatcgtgcagcaggagtgtgttgggcaaagttctgtctgagcacctgtgatgtgagggatggagggaccccaagcaggtatctatgatgatatcatggcagtggttgactataccagctgctggggttcgagccccagttctgtctttggccagttagtcccctcccaaggcatcagttccctcatttcctacccaaggagaatacagacagtgccagttcccaggaaggttgtgagcactgagggagaggctgtaaggggaacccttctaaccatggccagtgcgtgatgactgcttgggagaggttatcattggtgtgtccctttgtcattagtaatcacgggtgactccacggcagaagtcaggtacactgggtctgtcactcactccgtgagacagcgggcaggtccccaaacttctctgatcctctctatttcctggttagtcaatgggagattaaaccaaaaccagaggaaacattgtgagcaaaccaagagcacctccttgtcacctcagtttatgccgggcccctggctccgagctactgaaaaccgcagcatgggggagtctcctgggtggggtgcaccattgacaggaggcactgtttaaggcctcacaaaacgtgggcttcctcgccctgggcctgatggttcttgaaggccaggttccctgcaaatctggcctctcttcccagtcaaggctgaagtaaagggtgagtttccactgcttttcacagtgggtgttctgggggcaaggagctcccgcgaagaagaggaggaaaaacaagcctggtcagaggggcacagacatgtctccctctggcctggtacgtcgggacttcagcagcgtctcagatatcacaatcgtccggggcagaaattgtgacgctgccgctggggtagcttggcagctgtggacaccgttgctatgtaaggcgggaggtgagtcactgtctccaaggctcccctggactcggctttctcagcccctggctgatctgcagcctcatgccactgaatccatcagggcccatgcttcctttcattacagaacggccaggctctcctgtgggctggctctgctgtctcagggcctgacccgccatgtagaacattcccaggaacaagctcagctcccctctcagatctctcccaccgaggaactgaaagggggctgctgggggcagcagtcggacagagacgctctcagagcagcgagcgtgtgggaaaattggtcccgcaggcccaagggcccggattccaggatgcaattttcagcaatcatccctgaatccatgagaagttaggctgacatcggccctcgagaacagtgaggggtgactgttcagaggatgatgatttctgcagccccggctcggagagagcgcttttggagaaggacactgaggccagaaggcagcagagccgggtggtgcttggggtcgacgccagcttgctggttgcctgtgtcaagccaggctcccccagggaggatgtcggcatcttcccatgggcccagctgcctgttcaacaaacatctgaaaacttcacctcctccagcatccgaggaatatctggtgcgttcacaaaagggcgtgaagaagaccatcccccttcccttctgctggggaaatggcgggaagatggtggtgtcctcacagcccctccactgtgtgtctggggccatcagcagcagccccaacatccctcgccccaaagcccttgaagccacaatcagcgccctttgaagggaagctctgagggctggtgggctgtgtctgtgggcacgcctgtgtgtatctttgtatctctgcctatgtctttgtttgcgtgtgtgtatgtctttgtgtgtgtctgtaactgtgtatttttgtgtgtctgcatgtgtgtgtttttttttttcgagacagggtctcactctgtcactcaggctggagtgtagtggcgcaatcatagctcactgcagcctcgacctcttgggcccaagtgatccttctgcttcagcctttccagtaactgggactacaggtgtgcaccaccacccctggctgattttaaattttctgtagagacagagtctcactaagttgcccaggcttgtgtgtgtttcattgtgtgtatctgcttgtgtggtatgtctttgtgtgcctgtgtgtatttgcatgtctttgtgtgtgtctgtatgtatgtgactgtgtgtgtgggggggtgcatggggagggtgcagggccctggggtctgcggggtggatggtaccaccatctaccaacttttgccagagtacacaaggcctgccccaggaaagggcatgtgccggctttctaggggagagatgggataggagacccctaacagaaagatccagtgctctaaccgtgcgccccggctctgtcccctctccaccccttcttgactgtcatcatttaacatcctagctgcaggactttctcttttttggtttctttcggaaatgattatactccagagatgagacagccttccaaacatgcccctaagaaggcaaagggggcttctccacataagagcagacactgctcattttcaatttctgtaattttcatttcaaagggaaaataaaccagcaggcaatgccaaacaatttcatcatgaaattccggcaccgctcgctgctgtttggggtgaagccggcacctcttttagagatgctgccgaagcaaagcgtcccttccctcacccacggcttctcccttagacagggctgagtggcctccacccgctgcagggatgagttctaagtggcggtagggcggggtgccggctgctgggggaggctggccttcttgggtggagaggagtgggcttgggtttggagggggagccagacagatgtgcacagcagcaatgctgcagcccctgggacgcagctcatcgtcttctgtcaaagcctcctccccagagatcaggggatgggaaggtgaacagtgccttcggtaccctctctgagctgcttcgaggtctgtcaaaaagtaattacaggaggggcttgaggagggcaatgtattcagattgtaatgaagccaaacaccctgaatattcaggcagattccaaaccaccccatccttgcagccccagaatgtcacagtaagggctgctgagtcactgctaagcagggggtggtctgaggcagagagaagcaggagaactttccaggaagtttcccagccagctggatagagtactacaggggtgggcagaggcatgggaagcagaagtggggggctggacttgaatcctggctctgccacttagagctgggtgacctcaggtaagttaccttacctctctgtgcctcagtttcttcatctgtaaaatgggaataccaagtgtgacaggcagcctccaagatggcccttgataatctctacttcctggccttcacacccctgcgtagaccctccacattgtagaaggaccggtctgtgtgaccaatagaatgtggcacagtgatggtgccacttccgagattaggttgtaaaagacactgtggcttccttcttggccttactctctctctgatcatttgctctgggtgaggccagctatcatgctgtgaggacactcaaacaccctatggacagaggctcctgtggcaagacccagccatgggactgagccccagtcaagcctcaggtgactgcagccccagctgacaccttgattgcaacctcaggagaccctgggccagaagctcagaacagccactcccagattcctgactcacagacaccgtgagataatttgtgtttgttgttttaagttgctagattctgggatgatttgttacatggcaatagataactggtacaccaagggtcactgtgaatattcagggactggacaataatgccaagggcttagcacagcacctgctacatagcccacagctcaataaatggtggcaaataattagtctggtaaaactatagaccccctcctcaaaagaatgtttttagatgtcttaaataaaatacacatggcattaaaaggaaacctattctatgcagttccatccacacacctcttggtgggaggccgtgtatcccaagttaaaaattctcctgccttggtctgttgcccaggctgtctggagttgcatcccagtttcaccatggacaagcagtatgttcttggggtctttaaaccaggaggattagagaggaggcacagtgaagtcatggtggtgacagtactgttgctaaagcctgaccctcccccttcatgctaagcagtgcctctggcaggcagagtgctgaggcttacatgtgctgagatgcgtttgggaagaggcgtgaatattgtggggctgaatcctcagggccgtggggggctgcatggctgatgaccatgaggactggcctgtgcgggtacatcttcttggacgtgcggaagaagctcacgctgtcattggtgatgaggtctgtgaggtaatcctggggggtggggagagacaggagaacaggtgaggagccaggtattcatactggtgtccactacgtgccaggcaccctgctaggcactggggacacaatagtgaacaaaacaatttctgcccttctggagctgacagtctagggagcagacagacaagaaataagcaagtaaaataaatgaaatgccagacaaatgatgcaaatggtgctaagctaattggacataaagcagagaagtggatagggagaacagggcaggaattgcaatagatcactttagatagatattaaaataggctgggtgggatggctcacacctgtgatcccagcactttgggaggctgaggtgagcagatcacctgaggtcagtttgagaccagcctggccaacacggtgaaacaccatctctactaaaaatacaaaaattagccaggcgtggtggtaaacacctgtagcccagctactcagaaggctgaggcaggagaatcgcttgaacacaggaggtggaggctgcagtgagccacgactgcatgattgcactccagcctgggtgacaaagcaagactctgactcaaaaaaaaaaaaaaagatattaaaagaataatagctaacactattgagtgcttacgatgtgccaaggactgttctgtgtttacctgtatttgctcgcttaattctgacataactatagaaagtacgtatgatgataatccttattttccagaacaggaaattaaggcacagagaagctaagtaaattgcccaatggcacacagctagtaaatgttggacccagcactacatagtcttggctcctaagtctgaagttttttcaaggctctggggacactgtcatgcagggtgggtatatccctaagtccctggggtgcctacactggggcaggagcagacacatgtataaataaagaaccaaggtagttaaaagttatgacagatgaaggaaatatcataaaacagagagatgtaacaaagagtaactgggagctgaggtgaggggcatattttagctggggcagtcagggaggtcctctctgaggaggtgacatttgagttgagacctgaatgatgagaaggagctgggcataggaagatatgtatcactggattttgccagaatcccctggagagcttactgatacctgggcccacccccagagattctggttggattggcctgcggtttggcccaggtatcagacttttaaaaaactccccaggggattctaatgggtactcaggattgagaatcactgatccaggaaagagttccaggcagagataacggggtctgaggcaggaatgtgcttgccatgtgctctaaaaatagaagagagggcagatggcaactggctccttggaaagaggataaaatgtcagagggtaaaatgcagaaatgatataaggagcagcacacacacaaaaaagggatggggatgcagtaatgtctccaggaaaataaggaactgacttacatattgggcaagaggagagaagagttggaggaaaagtaaatggccagaactggaggctttaaaagctcagctaagaagttgaggtttgcctatactctttaatttttttttggtcatggagcaaaaaatggagcaatggtcttgctccattgcctagactggagtgcagtggtgaaatcatggctcactgcagcctccatctcccaggctcaagtgatcctcccaccttggcctcccaaagtgctgggattacaggcgtgagccacagcacccatacaactcttcctgaatttagtaaatatttagctgctaatctttcttcaaggtaatgacttcttgaaatataccctctgctagaaagcagctctgcccaaaacaattactttcaaaaagtgattattttcaagaaaaaaaggtgaagaggtgtctacagcttccaccctgaagtatacaacatatatacataccatgatgtattcatatatctacagacactctttcaggtacactcatccactatatccatatgcacaagaatggccactgcaatattgtttataaaacaaaaacattgcagtgaccagcaggaggatatatgtttaacagtatgcatgtatatatattatacacacacatacatattagagacaaggtcttgctctgtcaggctggggtgcagtggcacaatcatagctcagtgtaaccctgaggtcctcagctcaagtgatcctcctgcctcagccttctaagtagctaggactataggcatgtgccaccacacccagctaatttttcatttttattcttattttgtagagacagggtctctacagacagagtcttgagtatctaacagtggttagcccaagtagatacagctagcaagtggccgcccaggctgatcttcaactcctggtctcaagcaatcctcctgcctcagcctcccaaagtgtaggtattaaggcatgagccaacacacctggtggcattgcttccatactatgcaatgctgtgcagacattaaaaaggcatgtgtaaagttgtccaagatacatggttaagggtaagagcaagcaacagagtcaaactcagaaacattctattttttgtgggggcagagggaagggaaggtgaagaggagaaaccaaactctaacctcatatatttttgagcatcaaggaaaaatctggaaggatatcaaaatgctgattgaagactgggaagaggagagaagcggagaaagttacttgcttctttatatattgctccttgaatattatttatggattaattttggggagtaaaaacaattttataagggggctctacagaatttattacataaaaataatatatgttatataaatcaaagagctgctgctatagttttggaacgtgatataaaggtattagaaaagttcttaaaatgacaaaggtaatttacaatggatctaaaaatggtgcaaagctctgtaccctgacatcaacagtcagggcctgaaggggtcaagtcaggaaatggcatgagaatgagatggaaccgccagtggtggacacttgctgccacccgccagtggggtggggtgggaagccaccgttgctcttcataacagactcatcttcactacttcatcttagaactatatgcctgtttggccgtggttaaacttttttaaaaataaagctaccattaacctccattcctaggagaagatatacaatgggattctaaagcagtgaaaaagaacagagctacgtggatgaacacggatcaaacgtggataaatcttacaatgttatatcgggtgagaaaagcaggttgtggaaggatgtgtatgatatgatatcatttataaaaagtctaaggacacaaacacagcatcgtacattgtttgagatatccacctatgggatgaaagaataaaggtatgtgtgggtagaagctccaggatactggctacctccaggggagggctcaggccggggcaggaatgagacccaggagggtgggtcaggggctcccacagtctaatgtttcaaagtgtgtggggggtgattacagtacctgcctcttgaggctgacaggcaggttaaagcaccaatagatgtgaagctcttgccatagtgtcctgtgcacagccagctctctgccaccattcagctaagaatcaggactgtcttggtggctgggcagatttctccatgtctgagagctcccctccttatccatcctcctcagtggccactcctcggctaagtcttccccgatctctgctagctccgcaatgccacatgacacacctgcctccaaagctgccaccctgctccaccagtgggcagttagtgccaggccagccaacaagagccacccatccctccggccacagggcttcagccatgccctgttctctctgagggagagaacaggaggcctgggccagggtggcgggggcagcatccagcgatgctcaggggcagccaggacagccactgggtggatgtggggtgcgggaggggcgggtgacccccacccctgttggtctctggtttgggcagttgagggaagggtagagaaggcctgggccgggggaaaggctgagttcagagatgggcaaactgtgtttggggtgcccgggtcaagccatgaggaagaactctgaaattcagacctgtgagcaggagggtgagatgggtggaggtccacaggcccaggtgcattttccagaacccggcgcccaggagtcaggctctacccaggtgctgctggcctgcacagctccacagggctgagaagccacagctgggaccccgaggtgcaaccggccccctctggcaagcaccctctgagcctcaggtgattcctgcaggcatccacaagcttcaccgactgagtagctagtgtctgcggagactgccagcctcagccctaggcaaaagcgtgtttccctcgagtgggcactccgcaccgggcttccctccaaggccaaggcagtgcgtgtgggtggcagcagctccacaggctccagacaactcgtaatgaatgatcataggctcttcatgttatcaaataccttagctcagctgatcgtcacagcaactttgacaagtggacattatacccattttacagataaggaagtgaggtccccaaacaaataagccatgcatccagagctggagccaaggcctttgtatttttgggtcaggtccatctttttctccccgccacagataacattattaatgagaagcatacatagtggtttagagcaagtatgcacaaaccgttcctgtaaagggccagacagtaaatattttagactctgcaggccccctgtctctgttgcaactactcattactgccattgcagcttgaaagcagctatcaggaaaatgaatgggcatgtccgtgctccagtaaagctttatgtatggatgcagttttaatttcatgtatttttcacatgtcatgaaaattactcttaaaagctttattgtggtaaaaaaaaaatgagctgtatgctttttaacaaagttttatctgtgaagtagagtactgttaactctaagcaccatgttgtacagcagatctctggaactgtttcatcttgcataactgaaacctcatacatcttgaacaggaactccccagttccccctcccctcagccctgccaaccaccattctcctttttgctgctattgtctgactaatttagatgcctcatgtaagggaatcatgcagtatttgtccttctgtgtctggtttatttcacttagcataatgttctcaaggttcatccatgttgctgcatatgataggatttccttattttattattttgagacagagtctcgctctgtcggccaggctggagtgcagtggtgctacctgggctcactgcagcctctgcctcctgggttcaagcgattctcctgcctcagcctcccaagtagctggactacaggcatgtgccaccatgtccagctaatttttgtatttttagtagagatggggtttccccatgttggccaggctggtctcgaactcctggcctcaagtgatccgcctggtttggcctcccaaagtgctgggattacaggcatgaaccactgcgcctggccggatttcctttttaaaggctgaatgacattcatttttgtatataccatgtgaaaaatgctcttcttttgattgtttcttcaattagttgaaaatgtaaaaaccattcttagctcaggggccatacaaaaaccaccagtctgggcccacgggctgtggtttagtgcatggactttgaagccagatggcctgggttcgaattctgctttatcacttactaggctatgtggcccggttacattacttagcctctctgggcctcagttttctcatctgacagttgggaatagacacagtatatacctcacagactatgatgagaaatgcatgggttaatttgtgtaaaatgattcaaacagtatctggtacatggtatgtctaaatgagtgttagtcattattcctcaagaaccatatgcctacattttctttgtgaaaattaaaatagtacaaaggacagtgaagtctcatttgattagattactccttaccacccccccacccccataaccttggctcttctgtcccctactgggaataacctttccagtgttttgttaggtacattatagtatcactttatgcatctttttatattattaatcacatcatactgtacatattcatttatctatctgacaaatacagcagtgaacaaaacaaatgagcattcctgccttcatggggcttatattcttatgagaagagacagatacttaacaaatgaatcagtaatatacacagggtgtaatgcaccagatggtgatttgttgcagtaaggagtgtggtgggggtgcccttatacaaggtggtccaggaaggctaaagtgaggtgacatttgaataaggacctcaggagttctggaacttgcttttcccactctgcctgatgggctcaggacataaggcagaccggcctcatcctttgccgaggatcttccagaggagggatgcttcacggtcatttagttatttcgtgtattggtggactttgctaatttctttcagtaataaacagagctacaaccagctgctccatcacgccgtctcctgcctatgactgaggcttctccagatagacagagaagtgtacacgctgcggcaaggggcggggcacatgaagttcatagaatctgccaggtcgcccccacactggccgtgcactgccatcacctccctgcagagccacccaacacccaggcccacttttgccagctacctggaagcctcttttcgggtggactcaactctaggtcattctcacttcccttcccactaacaactgtcttcccctctccaaccctcttctgccattagcgcttgtcctgtatcactcttttctcatcaccactgcctctctttctgcccttgacatctggacccctttggtggcatgtgcccatctgtggattagtgacttgggacagagtcctcagaggccttctgaggggggcttacgaagggttgccgcttcctccctgcctgggcctcccaacaaggcccgcccgaggccagcagtgacattctgccttgccagaggcatcttactgcctgatctagggcccagggcacagggctcctgagctctgccttggctggaaaccccgggctcacccctgttcccttgacgcttgggctcctgctgcccactgctaccctcaggatttgaaccctggacctgagccagttctgacttcaccgccccgccctctgcccacgtccctgttagagcatctctgttcccaggcccctggtaactggggggccaggaatcctctcacgcctccctcacagggctgttctcattcacagggggagatgtgtgtgggcaggaaacagggcaaaaggacggacgttctatgtccccatgcttagccccaaaagaatcctgagcaccccgggataacttgattatcgggctgctctgagatgaggcgtggatgtggtgaagaattttaaaaaggagggaatgtatttttcaggatatttagagaatccgcctgcactgaggctgggaggagggaaacagcgtgcttagccctgggactggaatttatattccaaggagtccatgccggactgcctcatcagaactttggaattaattcacttgggaggctggaggcctactatgtgcagaatgagacttgagggcaggccgggggcggcttctgccacttgggcctggacccatcagacttacagggagcccaggatgacctgtcggaggcagagggatctccatgtgtgccggggtttccagaacagaagtgggacagagtgttttttggccgttgagcacctagtcagccttctcctggtggaaactccattcttatttggggctctattcccagccaacgttccagcgtagagctcctgctacccccatgtctggctcaggagtggagcatgtgacttatagtccagggaaccaggcatcctcctggccactctgattggctcagggacagacatgggactgatccagagccaatgagatgcactgagactctctgggactcctgggaaagagactcccatgcttgcagctggccaggaagctgggaggatataaggaaggccgcactgctaccaggaggagagagagcttctgtgaatacagtcgagcagacaaaaacagagctgacagtagagagaaatcaactccttgggggttcatttgaactcctggatccacccatgcctgatacccctatagctggttttcagttaaataggtgaatatatttcctctttgattaagccactgggagttaaatttctgttcacaaacaacttcaagagcctagtctgattaaaaaaaattaccctatagtggctgggtgccatggctcacacctgtaatcccagcactttgggaggctgaggtgggtggatcacctgagattgggagttcgagaccagcctgaccaacacggagaaaccccatctctactaaaaatacaaaattagctgggcgtggtggtgcatgcctgtaatcccagctactcaggaggctgaggcaggagaatcacatgaacccaggagacagaggttgtggtaagccaagatcataccattgcactccagtctgggcaacaagcacaaaactctgtctcaaaaaacaaaacaaaactgagatgactgtaataactagcaagcttggaggttgaaatggctcatactggggatgacaaaatagacgggtgtgatgtgactgtgtgtgtgtgcattaatgatgtgtgcacatcacttaacagtttatatcatatcttcatgtgccagactgtgagctccaggaggaccatgattgggtcatctgttttcattcaccttggaatagccagcacttggcatggtacctggtacacagcaggctctcaatgaatacttgttgggggtggtgaatgaataatggaaccaaatgtgactagtccactcccctcatatgattgttgtgaatatcagaagtactacatgttatcagaagtactactgtgtacccctgagcactacatagtaggtgctcaggggtacacagtaggtgctcagtaaatggaagtacacatgattaagtatgcaagggtatgcttgtttttcagatttgggagttgaggctcttaggagtacgtagcatgtccaaggtcacgtaatatgtgtcaaggttggggctctcaacttgatcccactgactccaaatgtgaaactcaccgtacagtccccggagggtgctggcagaagaacgacatggtgggctgaagggctgcaggcccatgggtcaggcatgctcaattgatgcaagattttagaaaagtctgaattagttgccaatatttaccaatcaggagatttcataggtaaaaaatacaaatttgtggcttctgttgaaaaatcaggaaaagtggccatctgggcccacagttctacctgggcctgatctgccccttttggacagacaccttctccaccgtctccaccactccctattgtccacacactcctggcttgctaccctctttcagtgactgcctgttctctagtgactttaacctgggaagtcacagtaggcagggcccaggactggtggcagtggggatgggaaaagagaaagagggatggatttggcagctggtctggggaaagaatgtaccagctgtggggggatgtcagagctgactctgaggattcagatggggcaggaagatttgttcatttccatatttcttttaaaatgggacatctggatgaaacatcactgtcagcctctcctccttctcctcctcatcatctaagccaggggtcagcaaactacagccaagcaggtcgactgcctgtttttgtaaacaaagcttccttagagcatggccatgcttgtttgtatattatctatggctgctttcacactataacggcagacttctgcagtggtaacaggactgtaagccttgtaaagcctaaaatatttagtatctggccctttacagaaaatatttgttgccctgatctaagctactacatactgagtatttactacgtgcaaggggcgcttctaatgttctacatgtactaactcacgtgatcctcaaaaacctttgtggtaaaaccataatgaaacaccgctacatgcccaacaaagcagccctgacaaaaaagacaacaccaagtgctgataagggatgcagggcaactcccatttccggctggagtgtaaactggtgcaacatctttttttttttttttttttcttttttgagatggagtctcgctctgtctcccaggctggagagcagtgatgtgatctcggctcactgcaacctctgcctcccgggttcacaccattctcctgcctcagcctcccgagtaactgggattacaggcgcccgccaccacgcagggctaatttttgtattcttagtggagacggggtttcaccatgttggccaggctggcctcgaactcctgacctaaagtgatccacccgcctcagtctcccaaagtactgggattacaggtgtgagccactgcgcctggccgggcgcaacatcttaacacatcctatgtcccagcaatccttctttgggtgtataaccaaaagaaatgggtgcatatgtccactaaaagccatggacaaagatgttcacggcagcttagtttataatagacccaaactggagacaaccaaaatgtccatgagttgttgaatgaataaataatacagatctcacagacattgcgctgggtgaaaaaaggcagatgcagaagagaacagactatacgattccatttaggtgaagttctagaataggcaaaaataatccacgctgtcagaagtcagagtagacgtcatccccagggtggggggtcatgactggagaggggtctcagggagtcttctggaagtgctctatgtcttgatcggagccgcggtgaaatggatgcacgcatatgtggaagagatgcgcggtgaaacagatgcacacgtatgtgaaaattcatccagcggtccacttaagatctgtgcatgttacctcatgtcaattcatcttatgttaaaaacagaaaaaactacgactgaggatcaaccactgctgcaggtgctcaggcagcacccactcactccgaacatgcacacgccctgtgctcagcaacgctgctgtgaggaacgggtataacagaaatgagcctctatgctcaccaggagctaggttctagacagtgctcagcagcgctatttgtaataaccccaaactggaaatacctaaatgcccaataaaagtagaagaaataaacaaattgtggtataagcgcatgatggaatgctgggcagcaagaatgaactcaacataatactaagcaggagaagccagatgcagagtgaatctgtaacgctaagagtctgaatcatcgttatcctcgcgggaggggtgtcgagtcgggggaattccgtgaggggactgctgcgggcggtggtgacattctcttcttggcctacccgggtgctcattacacatgtccgttcagtgtgcggcaagcctttgaatggtacactctgtgtatgtactttctgtaagaatattctgtctcggcaaaatgttaaaaaaccaaactcttggaaacagacactattttttgagaaatgaatacatttttcttttcttttttaaagacagagtcttgctccgtcacctaggccgaagagcagtgggaagatcctggctcactgcagcctcaaactcccgggcttaagcaatcctcccatttcagcctctctagtagctgggtccacaggcatgtgccaccacacccggctaagttttgtatttttttcgtacagacagggtctcgtcatgttgcccaggctggtcttgaactcctggactcaagtgattcacctgccttagcctcccaaagtgctgggattacaggcgtgagccactgtccctggctgagagatgaaaaactgaggaggaggtgtatgtaaaatgctcaaggtcacacttttaagtgcctgagtcacaatctgaacccaagtagtctggctcctgagttgggcctctaactgctgggccacacagccactcccaggctggaaaggttgcagcttaccttggagtagtcggagccgtgcttctctttcaccccgttccgacacagcgtgtagttataaaagcgggagtttttaaggagtccgacccactccttccagccgggtggcacgtaggagccgttgtattcattaagatacttcccgaagaaagctgcggagggagatggatcaggaggccacgtgagaaagtgcctgacgatgtttattaaactattgtgtgtccgaggcctgagcatgcacacctgctctgccatggagccctctggcacacagagcaatggatcccttctccaatgttattacgtgcattgaatacaagatataggattacagagaaaatcaattgtttggaaatacggttatcaaaatactaaacacatttgcgatacagtgtgtcttttattttttatttttgagatggagtcttgctctgttacccaggctggagtgcaatggtacgatcttggctcattgcaacctctgcctcccaggtttcaagcaattctcctgcctcagcctcccgagtaatcctcagctgggattacaggcgtctgccaccatgcctggctaattttttgtatttttagtagagacagggtttcaccatgttggccgggctggtcttgaactcctgaccaaagtgttgggattacaggcgtgagccaccatacctggcctactgtgtcttttaaaaccttgtagagagcgatcatttcagaatagttatgagtgaaaatattatattttgcagtatctgcaaaaactgcaatgggatattaaatactggtgatttctacagatgacaaagctacagattctgccaacatactgtggtttatggcttatgctcatattggaagcaaatgctaagtctcagctgtaggttagtgaaaaccagagtgtcactttttttcccattgaagtttgtggatcccttggattctgtctgctatacagcaaccagaatggctaacattaaagaaatgggcaacacctagtatgggtggggatgtgggacaacttgagccctcacacactgagtggctgccccaaccggtccaaccacggtggggaactctttggctgtgtctgctaaatttgaatgcattggtaacttctacccaacaatttaaatcttgggtatttacccaacagaaaagtattcatacactcacctaaactcaggtacaagacatgacagcacatttgtaatagtaaataggtagaaacaaatgaaatgtttatcaacaaaaggatgggtaaagaaattgttgcatatttacagaacggaaggctacattgaaacttgaacgaaagacctagtgctacattcaagaacagggatgcatctcaacaacctaagaatgttaagagagataaaccagatacaaaagaatacatgccatatgacgtcatctatgtgaaatttgagaacaggccaaactaatctatgatgttagaataaaaacagtgggtatcctggagactgggggagggtggctgggagcagcaaggggagtttctcgggtgatgatcttgttctatttcttgctggagcaggtggttcagttggtgacacctcattggcctggagatttgggagccatgcacttttccacatgcacgctttacatcaacaacaaagcttaaagaaaatcaccctaattcatcaggaaggggatgtgcctaaaagctctgtgataaggagacagacaagacctcttcatgatcctcttctgtttttattttgcatgtacattttttttttctttgagacacgtcacactctgccacccaggctggagtgtagtggcaccatcacggctcactgcagcctcaacctcccaggctcaagtgatcctcccacctcatcctcccgagtagctgggactacaggcgcatgccaccatgcctggcttatttttgtagtttttgtagagaaggggtctcgccatgctgcacaggctgttcttgaactcctgagctcaagcgatctgcctgcctcagcctcccaaggtgctgagatgacaggcgagagccaccgtgtctggcttgcatgtataatttttaataattataatctataaagccatatttaagaaatgggaaaatttgagtctagagacagcaatcctattctagtcgtctctttctagatgaggacactgcggttctgaaatttctgacgagtattgctgagagcacagaatatgagcgttccaggaggttgtagggatgtaaggagatcttgctaacagacagctcagcgctgggccttgtgcacgtgagtgcttggccgagaagccaggatgaagagagaaaggccagggaggtgaacccccagaggaaggaggagagtgggtgggatggggctctggtgcccctagaggagaggacaacctatccaccagtgtccttggagaaagcacagagccacctggccctgggggagctgtgatggagctggctccctctgcagcggttttcctggtgacctggcagatggctgacactttccaggagtgggaaaaccccttaggaacccaagcggctggattctgaaacccccaaaatacaaggcaaaggggagcacttcattaaatgacttgcccatcatgcagggccgggaggtgaccgctccagagggaggagctgatgaaacacctcctgtaagggtctgggtacacaggggaggtgaaaataggaagggaggatcccccagcagcctcaggggtaaggtccgggatggaacctccctttgtgtgggaggatggagcaaaaataaacgggaagaacctggcgttctgcagaggaggaggcggggaaccggctgcagtctctgagtctgagtcatatccagttttcacagagtgaaatgtaattaggtggtgggtgcctaattaaacagcgactgggcgtccctggctaggtgtcagggagtaactgatggagtggaggcagcatgagattcccgggcaagctaaaggcctgcacttctctttctctgggacctggaatgttggagatgcctcaatgcatccagctcctcaaagcagtggctcttggccagaaagggggtaatttctgtccccaggagacacttggcaatgtctggagacatttttggtttcatcacaacttggtgtgctgttgatatctggtgggtggaggccaaggatgctgctcaatattcgccgacgcacgtgacagcccccacgctacaaagactgagccaggacaaaatgtcagcagcgcctaatccaagaaaccttttcttttcttttcttttttttttttttgagagagggtctcgctgttttccaggctggagtgcaatggcgtgatgtcgcctcacagcaacctttgcctcctgggtccaagggattctcctgcctcagcatcccgagtagctgggactacaagcgtgcaccatgatgcccggctaatttttgtatttttagtagagatgaggtttcatcatgttggccaggctggtctcgaactcctgacctcaagtgatccacctgcctcggcctcccaaagttctgggactacagatgtgagccaccatacgtcgctgagaaaccctatcttatttaaataaacctgcctatggtccaaccctccagcatctcacccctcaggtctttggagccatattgtgagagccaggaaggcccctggagaccaagtgtagttcaggaaacaagatttcctaaaccttgtgaccttgacccccacctctaacgctgccctccatgcgggggggctccacttctgtaacactcctggcctctctccatgctctcccgtacctcctccgagggggacaatatacagcagaggtcaccaaacctttcctgtaaaagccagatagtcagtattttaggctttgtgggccagagggtcaaagggtctctgtgacaactgctaaaccctattgttagaaagaaaaaaaagaagtcacagacaagacataaacaagtgggcgggtatgttccaataaaactttatttactaaaacaaatggagggcctggttaggtccattggctgtggtttgctgacccctagcatgtgcctagtggatttgaagggccgaagtgggcatgcatagcccaatcccttcccttgcttttcctctggggactgagctgcccccggggagggctagttttcaggaggcttgtcctgtctgcgcggggaggagaggtgtggacctgcatcagtgggaagtctgtcacactctggagtttagtcaggaagcccaaatgctctcagaaggaagccatgccctcaaacccagccttcaccagattcatcagagtgcagtgttgactttcatcagctgactcttgggtctgatttcttaatcggctcaggacctcaacaaggaagagggtaaaatttaataagcccccacataaatcggtattcccattttttctaagaaaaagatgagttttattattattattattattttttgagatggagtcttgctcttgtcacccagtctggagggcagtggtgtaatctcagctcactgcaacctctgcctcccaggttcaagtaattcttgtgcctcagcctcctgagtagctgggattacaggcatggccaccacacctggctaatttttgtatttttagtagagatagggtttcaccatgttggccaaggtggtctttaactcctgacctcaggtgatccacccatctcagcctcccaaagtgctgggattacaggtgtgagccaccctgtccggcagttttattattttttattcttcttttttctccattttccccgtgccccacttcgccctttagaaatgcaattataaccttttatctcccctacaccagacactctcttcagggcaagttcatctaatcacgtgcttagaggctctggagcggaactctcactcactgggaggttgcctcgagagacaatggtccactacaacccaaagtatgcctgctgcgaaactccctcccaggtggagagcttctggccacccttacaacctagttccacccacaaaggcaccagtggctgccagctgacttcccggtagatgaagtactcgagtgagatatgcggacccccccagcactcaattcctcccctgtgtgccattcatgccaggcccccttttaaaaagcaactcctttctgctcctaaaagcaaagcagtacccttaaggcaggaagactgtacttcttcccctaagctagctttggaataaaaaatcactttctttataccagatctcgctcttattacctgcgtttttgttacacccctacagagccccgacactttctactcgtggcaaacaatactgtcagtgatgtaaaagattccttttgaaacaactgaagtccagagtgaaacaatctagggtaaaatgttaacagaatcagtgtacctgggcatggtacacctcatgatggtggcactcgaaattgctgaatttggggtcccactgccctagggaaggtatgcatgcctgtatccattcggcaagtgttgattaaacacctacggtatgcagggagcttcccaggcactggaatcacaggagtgaacaagaccaccaggatcccttctgccctcgtgcagttgatgttctagtggggaatgatgacaaatgcgatgaagaaaataaaggagaatgataggacagagtggccccacgcagtgctgtgagaggcctcgctgggctgaagagcaagagtcagaggggataggaggaaaactgttccaggcagagggaattggcaggtacaaagtccctgaagccagtacaaacgtgggggcatcgcagaacccaagggggacagtgagggagggaggaaatgacatcacggggaagaggggacagatcccatagggtcctggagactgtcatgaggagtggcagggttcgtaccgctcctggaacattgcatgccagattttgccttttgtgcattttcctggaaacaagtccacagcttttgacacattctgaaaggagcccagatcacaagtcatttaagaagcacagattttcaccccctcagtttgcagaaaagtgaactgaaagtcagagaaaaaggcttcactgaactccccactggggaactgggtttcccgctacactcccacatcttccaaatctccagccagtgaacctactggttcttgaagacttgggccaaggtctttctgatgaatgctggagtttagcttcttggcttggctgctgggatatgaatttcttcatagggagtgggtgggggtcctcctcctgcccattcttttcagtgccacggatgtcagcttaatgcaagctgtttcctctgctagcatctcccctttcacgtctctttcctttctccaacccccaacccttaaaaacccaaaaagggtgtattattcagtctccaccaggccctagaaaacagggcttcagtcagaggcttttagtgccaaattagattttgctctcatttgattatatttccccaaggcacttttaaaaatggttattccggcaccagtggaggtgggagaagcaaattagcatgggccccggggctcctgggctgggagatacagccaagagaatgagctggaattaaaaccaagattaaaagcccagcccaaattgtggcaggtggctggtgcctgggaagcttggattcgctgagctttcgaggcaaggacagcacaagaggaggggcaagctgggggctggcgtgggggtgggaaaatttggcaggcagattaagaggaattaatggcaggccaggaaaggccattgacaatgagctggctggcgactgcccctgggcagcagggctggcatctgctgaaaggccagagcacttactgcctcctgtgtgcccagcactaggtggaagcttcacctgcctggctctgtcatcctttgggcaccaacacttccttatttaagttgcacgggctgaccttgactgttgactccaggaatgtgtgcaaatccttgactcccatgaggaccgcattcccctggtgatcatgcacaaactggttagttgaggcaaaggcatgtgacccaagctgggccaactgcagcgagtcagccctgggatttttagggagctactagaaaagagaaggtcttcttcctcaaggcttggaactggtgggatacataactgaagctgctggcagccatcttgccaccaagagggaagagtctgtgtgtgtgtgtgtaaagcaatatggaaaaatgcggaggtgggaaagatagagacagagagacagaagagatagagagatacaagagatagagagatagagagatgctggtttgaggccctggggatccactcttacctgaaaccactttttttttttttttttgagatggagtctcactctgtctcccaggctggagtgcagtggcatgatctcagctcactgcaacctctgcctcctgagttcaagcgattctcccgcctcagcctctcgagtagctgggactacaggtgtccaacaccacgcccagctaattttttaatttttagtagagaccaggtttcaccatgttggccaggctggccttgaactcctgacctgaggtgatctgcccgcctcagcctcccaaagtgccagaattacaggcgtgagccaccgtgcccagcctaatgttttaatttttagtagagatggggtgtcactatgttgctcacgctggtctggaactcctgggctcaagtgatcctcccgccttggcctcccaaggtgctgggaatacacgcatgagccaccatgcccaccatatttttactgtactctattaacatgttcacgtatgtttagatacacaaatacttcccattgtgttaccaccgcctacaggattcagtatggtcacatgctgtaggggggtttgtagcctaggagtaataggtcacgccacagagcctaggtgtgtagtaggctatgccatccaggcgtgtaatgcactccatgatgttcgcacaatgacagaatcacctaacgacacgtttctcagcatgtatccccattgttacgtgacacacgactgtacattgcttggaactggcacatagcaagtgcctactaagggttatattttcattatccaccaatgggcccgtcccctgttatagccaacttcttgctgttaacatctggtttaatggagtccccctgcccccttggagaggatcactagctccccatatccttcctgcaccctgcttcgtggcccagcaggtcggccacttcccctgcaggcagctctacggtggaggctccacgcggctgcttccccatttgtctgagttaagtgctcctggggaacgattcggagcctgatgggaggaggagacccttctgttttctctcccagccccaaatctaactgaaattgccttgtaataattgcatttgtggtctgtgaaagctgtgtctcgtggcgaccagggactgagattagctggtgaaaaacctggcacaggggcacacacggcatcactggggatactaagcaagccacggacaatgggggagacagagggctcctgcaaccagaaaccactgggaacctcggccacctctccctgctgcagacatgtccccgccatgccgggccggcgtaggaacacgctgttcctcccagcatcagttctcccttttcccagtaacacaggtggtaatgtggcagagtgcccaaagcgtctctgcagtcagactgtctgggtttgaatcctggatctgccacctcctagctgtgggaccacaaaggactttgtcccctgtggttgttggcaatgaaacgacagtgcacccccacccactgctatgcacgtggatgaactgacaggcatgcgaagggtgaaacaggacctgatctgtcctaggggcctcccaagaggcagccagcaggacagaaagcacccgctgctttcggaggactttctctcccccacgacgggccatctggctggaaataccaacagggcttctttaaggacatcagcaactttcggtacatgttcatcccacaccatttccacccacacactacattaaaggtaatcgacaaacagctctctaagagtccaaatgttccagagctgactcgctgaatcatgcaacaccatttcattaaatatttattcactttgatttggcaatttgtcctcatattttggaaccagcacacaaacacatctacgcacctgcataaatatacaacacatacatatacacacatgcatgaatacatatacacaagcacaaatacactacatatacatacatgaatatacaacacacatatacacacgagtgaatacatgacatataaaaatacacatatgcattaatatatggcacacatacgcacatgcatagatatacaacattcacatatacacaatgcatgaatatacaggtacatatgtacatatacacgatgcaggaaaatacagtaaaagcacatatacacacatacacgaatacacaacatacacatatacacaggatataaaatcccaaaaaagacagaaatgcatcttgcttcttcacctgtttccttctcacagccaacttccaactggacttctgcctccgcagccttcccagagcccagacttccccaaatggccagagggcccttctgagtccaagagccatcaggccgtctcccttcagggacgcactgctgagctcactctgtttcaacttctctaggtctcacgctccctaggagccaagctctctaccccaccgagcattggcacctgctcttccttctgcctgggacgcctgcctcctcctcaccgtggcacctcaggtcagatgagaagttgtccctggtcacccatccctctatagtcaccgggctgtttatttcctctacagcactctgcactctctgaaattatcctatagatgcatttgttttcttgtttatcctcatttccccaactagggtgtggggtccgtaaggcaggagccgtgctgcactgtagccccagcgcagtacctggcccagagtgtgcacacggtgagcagtggccgacaggagggctgggtaggtgcacctgattgaggtacacagctgtgcaaggtggggcagcgccctctaatgttaagcgtcacacccctcgcccaggagtgcaggagaggtggcaactgcatgtcttactgaaagggattctaggcctggtgtggtggctcacgcctgtaatcccagcactttgggaggccaagatgggcagattgcttgagctcaggagtttgaggccagcctgggcaacacggagaagccctgtctctaccaaaaaaccaaaaaattagccaggtgtggtgctgcacgcctgtcgttccagctacttgggaggctggggtgggagaatcgcttgagcccaggaagtggaggcggaggctgcagtggaccaagatcctgccactgcactccagcctgggtaacagagccagaccctgtctggggggcaggggtggggggagaaaaagaaaggaagggatttctattatagtgtctgcagcacagtgctacatgctgaaaaaaatgggtcaacggagcaggcagggctgccaacctgaagcacatctgtgtgcagaatacactgaaccaggggtgattttgccctgcaggggacactgggcagtgtgtggagacatttttcactgctatgacctggcggggtgggggaatgtgctacaggcatctatcgggcagaggccagggatgctgctgaccatcttccagtgcatgggatggccctcctccccccgtaaagaatgatccagccccaaagtgtcaccagtgccgaggttgtgaaactctgtgtaaagtgcacagtttaaaaagttgtccaaatgtaccattaacgacagggttgcagtgtggctttaaagagcttggtttgcagagtcagaggactctgactccttgggcaagcgagtgctcctgtctgagcctcagtgaattcttctataaaaatgggggcagcaacaaatgagattgtgcataaagaactctgaaaaagggccaggcgtggtggctcatgcctgtaatccaagcactttgggaggccaaagtaggaggatcacttgagcccaggagtttaggtctgcagtgagccatgattgtgccactgcactccagcctgggcaacggagtgagattctgtctctgaaaaaaaaaaaataataaaaaacaaaaaaacagaaacaaaaaagaactgtgagttcccaaaatacagtctgctttccgttttcagggagggggatgaaaacttggacctctggagaaataaaaatggttgttagaaaccagatgtgacaccgttttggaaaatggcaaggcccctccgagactccagtaatgagcttggggaggagtgttcatgccgcacagtgaagtcggctgagcatgacacacatctatcagcagagatgggctggagcgcggagccgagccaatgacaataaacagtgtttgccaaagcaattcagagaggtcggcgaaagatgaagcagaagcctgtggaaagtccgtccttcccaaaacagacccgcgccatttcgcaggcacggagtctgcgaaaacaaaacggggtctttgcccttcgtggcatcatctcaattccagttgtccgcgtgcctctcacacacgtttggccgtttttatgtatcatttggaccgctgcatacttagtaatttccttcaaatcacttcatttggtgtcaaatcagcacttcacaccggcctcttgattttcgccctgtgatccatacatccgtcaatgccagtgggtcaaggctacgcaccatggaggggacttcagctcctctgtcctccctcacatatgtcccagcagcttcaccctcaggacacatccaggtctgaccacttcccatcatccgcctgtcaccatcttggtccaagccaccactgcctctgcctggaccttgctggaacctcgtccctggtcctcctgcctccaccttcagcccatcttccacagcagccagaaggatcccattaaatcacaaatttgatcaagccccccactctgtgcaaagcccttcagtggctccacatccacctcaactaaaatccaaagtccttgccatgccctacaaagtcctataactgtctcctgtcctgctccgtgactgcatctgcccccactttccccccagcctcctgtcctggggtctccctctatcctaccagcaccccaaccccaaagctcatacctgccccagggcctttgcccttgctgttacctgaaagaaatcaccttcctcagatacctgcatgggctgcttcctcacctttcccagctatttgctcaaagcttttaatttttttccaatacagggtcgcactctgtcacccaggctggagtgcagtggtgcggtcgtggctcactgtaccctcaacctccccaggctcaagctatcctcccacctcagccttccaagtagctgggaccacaggcacaagccaccatgcccagataacttttgtatttttttttttttttttttgtagagacagggtttcattatgttgcccaggctggtctcaatgcctgggctcaagcgatctgcccaccttggcctctctcagttctgggattacaggtgtgagtcaccatgtccagcctcaaatgttaacttactggggctcaatcctaaccctcctattcaaatggcatctccccacaccgcccaggctctcccctttcccccgacattgcttctccacatatttattcactggtcatatttatctgtcttctagtttttatcacgtgcttctcccaccagagtaccagccccatgagggcagcggctttctgagtcccttgtcccctgtgtcctcacatctagaacagagcttggtcagtgacgagacctcgatgaacgtttgtggaataaatgggtaaacaactgaaccaacgaacacctcgtaatgggaggcctgtgggagacacagctgagtgagggaatgtcgatttttttttttttttttgagatggagtcccacactgtcacccaggctggggcgcaatggcacgatctcggctcactgcaacctctgcctcccgggttccagtgattctcttgcctcagcctcccgactggctgggattacaggtgttcgccaccatgcctggctaatttttgtattgttagtagagacagggtttcaccatgttggccaggctggtcttgagctgacctcaagtgatccacccgccttggcctcccaaagtgctgggattacaggcgtgagccactgcgcctggctgagaacgtagatttgtttttttatcatccggtgcacaccctctgtgagtggaggagtgggtagaattgttaaattcttgtcttcctatttgcttgtatggtgtttggctggctgaacttggatctatttggcccacacgggacatgacttccatttgtggatgtgctttataaaaccaaaaaagcactcaaggtcagtgtaaggcaacagcagtgcttttcaatatggtcaaaatttattaaggaacccagagtcctgtgtatgttggttatatctagtgatagttattatattagagatgaaaactgagaaatttaaaacatatttgttcactcatttaaataataaactcactacttgttagcatacatttaaaaaatgataaatagaggctgggcgtgatgacttatgtggtcaggagttcaggaccagcctggccaatgtggtgaaaccctgtctctactaaaaatacaaaaattagccgggtgtggtggcgggcgcctgtaatcccagctacttgggaggctgaggcaggagaactgcttgaacccaggaggtggaggttgcagtaagctgagattgcaccactgcactccagcctgagtgacagagcaagactctgtcttggggagaaaaaaagataaataactatatttttcccaaacaaaatacaattaatgagaagagttgcattgttttacatttttgccaatctcttcaatgtcttgtttactggaaggcagcaggattcttaaatctgttttggcattcaatctgctgagatatattgttttggttgtttaacatgaaaaatccagcctcacacagacatgcaggccagggacagtggctcacgtctgtaatcccagcacttcgggaggccaaggcaggaggattgcttgaagcaaaaagtttgagaccagcctgcgtgacaaagtgagacctcatctctacaaaaactaaaaaataaatatatataaatatagccagtcgtggtggtgtgtgcctgtattcccagctactcgagaggctgaggtggcaggatcacttggacccaggagttcgaggctgcaatgagctgtgattgtgccactgcacttcagcctgggtgacaagcgagaccctatttctaaaaaataaaataaaatgggtatgcagatggaaaagggaagagtattttaatcctttttagataactagatatgctatgtacctgctagaaaactccactgtctaccagaaggaaaatgacggtaaaaaggtaaacagtgtcctggtattatcatgaaaatagttttgagtctagagatcctgggaccacgctttgagagccactggtttagacgatgacctacaacatcccagtgaggtagatcctttttttggtccctattttacagatggagaaactgaggcacagagaggcaaagtccccttttcaccgaacatcccacaactgccaagtgtcagagctgaaatgaggctcaatcccaggttgtctgtctccacctgccttttggtgactaccctgttcagcctctcagcaggactccagcgaccacagactggagctcttcccatccacggggacgcagagaggcagggaagagggaacagcagagggactgccccatggctaaaggtggggacacacacaaatgggactcagcctccgagagctcctcctctccgatgtggctcagactatctccgaagtgctttctgccagaattccaggcaaagggaatttccacactgaggttatcttcccatgctgcatcctcccagaattcatccggccgtgggcttttgaaggaaggtcattcccaggacccgggcactttgcctttcttgaagcataggtgggggacacaggtaggagccatagtcgttatccagatcagtctttccagaagtgtagggtttcagagataattttttttttttttttttgagatggagtctcgctctgtcacccaggctggagttcagtgctgcgatctcggctcactgcaaacctccgcctgccaggttcaagcgattctcctgcctcagcctcccgagtagctgggattacaggcatgcgccaccaccatgcccagctaattttttgtatttttagtagagatgggatttcaccttgttggttaggatggtcttgatctcctgacctcgtgatccacctgcctcggcctcccaaagtgctaggattacaggcgtgagccacctggcctggcctcagaaatgatttttatcctccgaggcaggcaggtctgagggctgggcatgggctctggagccaacagcttgcatttaagttcagctacctctgccttccagctcagttttctcaactgcaaaataggaataataataatatccctacatgacaaagttgctgggaaagattcaatgagaaaatatgttaactgcctctaaatggttactgtttttatcataatattattgatcatgatgttatatattcattcattcaatcagtaaacattaaaggaggactcctgtgtggctgggatggctctaggcactggggataccagtgaacaaaacagaaaaaattaaagcagcaaaaaacctgcatcttcctggagcttctgtcctagaattaaggccagtccgaggcagggaactggaatgtttggagactctcacagtcattcaggagacagactgtgatgaccacaatcgtggcaggcgaagggcttgggtggttggttccaggctatttttaaaggtggaaccaatgggatttgctgatgtggcatgcgaaagaagtaaagagagtcaaggataactcaaggtttttggtccaagcaatgaggaggacagatttgcccttatttaggaaagggacactgggaggggcagagttggggatgggggttgataaagaaatcagacacattaacctcgagactcaggttagacattcaggtggaaacagaccaggttcacagaaaagctacggaattacaaactgaggagctgtaagcatttagatggcacttaatgccatggaatcgaatcagatcacctgaggaagaggttcttaatctgttgtcccaagatataatttcctgaaattgaatggcaaaagtatgtatttgtttattttcattaacctataactagcatccccttcaattatgaatgatggtccctgggactttgtcaccaatgggaattacggatattttcatatcacattgtagtcaacatggacttcttaaaatatcatttgagccagcgctacttcgaaatcatggaagttatcagacctatccattgtccattaaataactgcttcatcgtgccattttatgtgtaaagaagcatacatatcacagtttataaaatattttgataaatatgttttcatataactggcttcctttgtaattctctgtattttctatgaactggaggggtacaccaggtggtgtgtgacttctggaaactcccctccaggaagggaagtgagcttcccttatagtttctgtgtcctgctggttggatgcagacaggatgggatgctgctttagataaggacgatcgcccaggatgatggaacgccatctgaccatcacccatcaggagcctgggagccaacaccatgcctgccacatcatctctaggctgtttatgcccaaactgtcaaatgggagagaaataagcacctatcatctctaatccgctgttaattagggactgaagtaccctcaactccacctatattctaataaatcctgggggtatctgtggcacaaatccagtgggctggcgccacttaggagggctcagcaaactatttctgcaaagggccagactatgtgttttcagctatgcagccataaggtctctattgcaatgattcaattctgccaccgtagagccaaagcagctacagacagtacatacactaatgggtgtggctgtgttccagaaaactttgtaaaacctggcagcagactcctgtaggccacagtttactaatctccaccatgcaggaatgttaccagtaatggcaataccatcattatcattattatctttttcaaatttttgttttattttttgagacagagtcttgctctgttgcccaggatggagtgccactgcactcactgcaagctccacctcccaggttcacgccattctcccacctcagcctcccgagtagctcggactgcaggcacctgccaccacgaccggctaattttgttcttgtattttttattagagacggggtttcacggtgttagccaggatggtctcgatctcctgacctcatgattcacctgctttggcctctgaaagtgctggaattacaggcttgagccactgcacctggcctttattttattttattttttttgagacagggtctcactttgccacccaggctggagtgcagtgacatgatcttggctcactgcaaccactgcctcctggttcaagtgattctcccaccttagcctcctgagtagttgggagtacaggtgcacaccaccacgcccggctaattcttttgtatttttagtagagacagggtttcaccatgttggccaggctggtcttgaactcctggcctcaagtgatccacccaccttggcctcccaaagtgctgggattacaggcctatcataatctttttttttttttttttaaagagaagtttgtaatctgggtatttttggttaaatttccagattttaaaaagcatcttgtaactctgacagaaatttggggttgaagtgtagactcaggctgccagctgccattttgcaagatccatatttggcccccagggtcacaaaatagaaactgagctggttcaggctgagttttgatcctacccctgacaccagtagaagagtcctccactgggccactttcatgatctgtcatttggcttcctggggctcccggtctgggcagcagagaacaatcccattaacctagcaggggagctggaggttcctgaggaacagtgataaatgaaaaggaagcccttttgcaaactctagaacagcataaatattagatgtgaaatgccacaggactgaagtctttgtttttttggcagacaaattggctgaggaggcagggctggcaagaaatgcattaaataaacccagagctccacagctctcagggctggggtatttctgatattctgtaactggatccttttaactttgtgctgctttgcaaggttacagcctgagtcgagttcttctgcttttgaaaaaaaaaataccaaatgcaaatcactgcacgaagtgataaatcaatgctataaaagttctggatgccagagatgggatcttgctgaactgaaagctgtgtgaaaacaaatgaggaaggtggggtcatgattccgcacgaaagaggcatcttatgttggaagcagagcgagctgggggctgggagaaatgctctcctcccacttgccctttaagaagaagctatttttttttttttttatgagacagaatttcactcgttacccagactgcagtgcagtggcattatcttggctcactgcaacctctgcctcccgggttcaagagattctcctacctcaacctccccagtacctgggactacaggcatgcgctaccacgcctggctaattttgtatttttttagtagagacggggtttcaccacgttggtcaggctggtctcgaactcctgacctcaactgatccacccgcctcagcctcccaaagtgctgggattacaggcgtgagctactgcgcccggcctgcatgtgggtttctatagtggatatctgttttatttttctgcccagaatccattctcctgtcttttcataattgtgccttcagtcaccaaagagggagggaaccaatctttcccctttctcagccttacatgttctgatgaggctctttctagctctgaatcctggaccaggcccatgaggttggcctggacaatcagggtatctccttttgcctggctgctgtgattgggtgaaagagacataagaccctagatgagccaatgagagctttccctggaacttttgctggagcccttggaaagaggcctctctttcagctggggtcaccacactggggagatggacctgtgggggccatcttgccatcacaaagagggaaccttcctaataaagccaacccaatgacagaaaacgcaagaagcagaaagacagggttctgacagcgtttgagcactgggacctggcaaagtttgcctgaactaatttcgattatgtttcttcatgctggataaatgagatagtaatctaaattccattttgtttttatttttttgctgacttcaagcctaaggcccaagagttctccatctgttcattttttttattcgtttgagttgaggtttcacttgcccaggttgtaatgcagtggcacgatcatggctccctgcggccttaaaggcctgggcttaagtgatcctcccatcttagcctctcaaagagctgggaccacaggtgtgtgccactatgcctggccagtttttaaaattatttgtagagacagggtctctctatgttgcccaggctggttttgaactcctgggctcaagtgatcctcccaccacagcctcccgaagtgctgggattacacgtgtgagccaccgtgcctggccttgttcaaatctttactgagtacccaatacctgcctggtgctatttttggatgggcagcaaacaaaacatgtaaaaaacaagttcactcgccaggtgcagtggctcacgcctgtaatcccagcactttgggaggccgaggcaggcagatcacttgaggtcaggagttcgagaccagcctggccaatatggtgaaaccctgtctctactaaagtacaaaaattggctgggtgcggtggctcatgcctgtaatcccagcactttgggaggctgaggcaggtggatcacttgaggtcaggagttcaagaccagcctggccaacatggtgaaaccccatctctaccaaaaatgtaaaaaattagccggttgtggtggcatgcaactgtaatgccagctacttgggaggctgaggcaggagaatcgcttgaacctgggaggtggaggctgcagtgaaccaagatcgtggcacagcactccaggctgggcgacagagcaagactccgtctcaaaaaaaaaccaaaacaaaaaacgaaaattagctgagtgtagtggtgggtgcctgtagttccagctacttgggaagcagaggcaggggaattgcttgaacctgggagttggaggttgcagtgagtcaagatcatgccactgtactccagcctgggtggcagagtgacagtccatctcaaaaaaaagaaaaaaaaaaaagttcacaaacatgcaagataatttcaagggggcgagaagtcctaagaagaacataaagccgggtgtcatggtcgagaatgagagggttgaggagtactaaccgacacaggaagggcaggaaggaagagagaatggatggaggaagttctccgcagtgtgtgaacaacgctctagaccagggatccccaacccctgggctgcagacaggtagacaggtagcggtctgtggcctgttaggaactgggctgcatagcaggaggtgagtggcaggcgagtgagcaaacttcatctgtatttacagccgcttcccatcacttgcatcactgcctgagctctgcctcctatcagatcagcagcagattatcataggagcgtgaaccccgttgtgaactgtgcatgcgggggatctaggttgtgcactccttatgacaatctaatgcctgatgatctgtcactgtctcccattgcccccgggtgagaccatctggttgcaggaaaacaagctcgggctcccactgattctacattatagtgagatgtataattatttcattacatattataatgtgataatattagaaataaagtgcacactaaatgaaatgcgcttgaatcatcccaaaacatccctcacccccagtccgtggaaaaactgtcttccacgaaaccggttgcttgtaccagaatggttgtgggccagtgctccagacagaggtaactgcacatacaaagggcctggggcaggaatggaccttggaagttctgaggaacaaagaggctaggcagcctgagtgctgtcaccaaggaagggacagataggagatgtggacagagaggtgagcacacccaggccaaacaaggtcttggcagccctggcgaggagatgccagtttatccaaaaagcagtgggcagccgtaggaggttttcagccggaagtgatgtggtcaggtttacaatttttaaaagtgtcctccggctgtgggtggggagaaggaatggccagttgctggggacaaacagggacaagcagatcgccagggcgagaggcgagagctgcttctgtcttgccactccatgcattcctgtcttccgcctgcctgtttttagtgaggctgtggctattgaggaagactgggctgcgggggacaccaaggccctgctgactggttgtagcagggccaggcggagctctgggtgttggtggcatggagggcgggctgcctgtgcctaattaaatgctggctccagccatccgctccctagaagggtcttgcagctcctgcaaatgaggatgaggcccattcattccctggaaactcaattagctgggtatggagggctccatctctagtgacaggttttattgcctgctgagtcaccacgaggacaagctgtgtcttaaatatctgtcttgtgccttttaaagtgtggttttgttcagagggatggactagaggagggggagaaaatccacaacagaccctcagaacaaggcctgtcactcaatggatatttaattatcgccttggaggaatctgacactacttgcacctttcaaagagctgttctcagcgccatcagactgacctcccatttctatgacaaatattttgtagagcgcccttgttttcttgaaaggaaatttataggtaacaaaagctacctatgcatgtcatttccacaaaatcaatataatgctctaactgcaatctacagggaaaataaaaggaaagcaatttataatgaagataaatttcaatatgaaattcccccagcacatccatcaagaaggcacaacacagtagtcaggcagacgcctgcacctagacacagattcactgggaatgtgacaattacaagggcagctgggtgggcgggcgacatttgccattcaaatcctttggcgtagcactgtcatcggggatgggactttcagaaataaggaatgactcttgggaaagttttgcactcaagtataatattgcctccattttcttattccgtacattcctgggaatatgcaaaaaccctccagtatttacatataaaatagacgtaggttcaagactcagatgacaataaacataaaataatctacccatatgagtgatgtggtaggaaactcagaagctatgtggaatacaatgcaatgtgggggccacgtggactctgctgtgcagagcaggacatcaaagtccttcttagtctccgcccccaggaagccagcaaagtcaaatccttcaccatcaccggcaatgcagtcacagagtttaacccctagggggcggtgtgctcccttgagaaccaccagcttagaaagaagtttgcaagccggtggcctgcagaccaatccatccctcaggtgtgtttgctgtgggcctgcccggtgttttcagttgctcattcttaaaaagtagagtgaacagtccacagttgaaatctgggcaccccctccccacccagcctgcctctctgctttgggctacctgccagccctctatgcatttggagcccccaggctagaacgggttcacacagggatgacagaggaagccccgctcccggcctcggtgtaggaactcggtttcccttcatttgctcaaatcccctgcgacacggatggattcccaaaggactcgctgtgtgggctggcacaacctgctggccccgggatggatggtgtctgctgctcggagaacaggaacctgtcctgagaccctgacccgagacccaggaaggtttgggaagacagatcaaggtactgggagcataaggggaagtgagtgcagggatgaggaggaggagattggattacagatgaggaatcacggaaagcactcacctaaagttcgacagccaccaccccctgcgtttttattgccccttctcagtgctgtgtgtcactccccactcccaaaagattttgtttgattaggctttattcttctttcttttttagagacaaggtctcactctgttgcccaggccgaagtacagtggtgtgatcatggcttactgcagcctcaaactcctaggctcaagtgatcctcctgcctcagcctcccaagtagctgggactacaagcatggactaccatgtccagctaattttttttttttcaaattttttgtaaagatacaggtcttactatgttgcccaggctggtctcaaactcctggcctcaagagatcctcctgcctcgacctttccaagtgccgggattacaggcccagccataggctctattctcctgctgtccaagagtcctttctgtgccaatggaaacattctctatgtgcattatccagtacagaacccatgtgcgcctactgaatacctgaaccatggctagtgcacctgagaaactgaaatgctaattgtaattaacgtaaagttaaatagctccctgtggctagtggcaacggtactgggccatttggctccagcctaactcattccagaatgttcagggagtcacagctagcacctaggagaggactacaaaaggtctcatgcactctgaaacccccggaagcctcttgaggcccaggagacagggtgtgcctgtctgtcaccacagtcacccttccctcacttttgaccctgcagctgtttcaacgcccactgcaggtggagattccttgagagaaaccatggttgggaagggaaggctacgcatggagctgatcttcagggcggccacactgctccccacccaggaccacagctggggcagtgaagaggggaagagcggcaggtttgctcagtttgacatcggctctgcagcctttatgggggggggcggggtttaatgtgtgaaagaaaccagccgtcacgagatgaatgtgttccccaaaatatatgctcaagtccttgcccaggtacctgtgagggtgaccgtgtttgtaacatggtgttgtaagatgaagttacgctggatcagagcgggctctagtccaatcactggtgtcctgacagaagagggaaatttggacactgattcagagaggagcaggccacgggaagagagggacccacagggaggaggccgcatgaagatgaaggcagaggctggagtgatgtggccacaagccaaggggtgccaagattcccagcaacccccaggaactcaagggcaaaggaccctcccctgaagcctgcagggaaagcgtggccctgatgatgcttgattttggggttctggctcccggaactgtgaaaatcgccttttgttctaagccacccagtctgtggtccactagggaagtggatacacctgctaagggggtgggacagagagggtgtcgcctggaaacaatcggaaaccctgccccatcggcctcacatcagcttcctctttccccgtggccacttcctcttacggcgcagggaacctctcctcctgggtttgtgggcacaggtcacgtatcactcagggtggcgtcttatcacaggcactgggtgactagtgcttagatgtcacaacactgctgcacagatggagagactgacgcccagaggggatgaggtctcagctcaaggtcacaagggcgcttaaggcggagtctaattctttagactcttgctcaaaacaagtgcttcacttattttgaaatctgaggtcttagagaaaggaagtgactatcaaattagaggaagaaatttcgcttgaagatgtgcacggaggcggcaaatccgtgcctctcgaggacacgctgggtcagcctgggtcccaggaggggctgtgcaattcccgtggatactcggatccccacagtggggaaggctgggtgttcgctgcagagagacaggaaggctacctgctgtgagcagtggatacactccacggggtgaatggagaggctctgctgtccccccacaggccggagagggggagggaagatgggcagatgagaggcagctggaccgagggaagaagggagctgtgtgtgtgcgtgcgtgcgtgcacacttgtgtgcactcaaggagagaggaagagagcagggagcaaacccaggagaagagccaagcaaagagaaggctgccattgtgaaggcagggacagctgcaccaggggcccagggacggcatcccgggaataatttcagtcttctcttccctgtgtgtgcagagaggctgagaagaaagaggaggaaaggctgagatggtgggagtgggggtggagaggagagaaacgggagaggagaaaggagtgtggaagagatgggggtgggctgctggcggggacagaatgtggagacttagtcaccagtcatcctgggaaggtctcctgagcacctacgatggggtgggcactctctaggcctggcaacccgcgagggcacagaacagaggccgctgcttccagggagctggcattttatttatttatttttgagatagagtctcattctgtcacccaagcgacagagtgtagtggtgtgatctcggctcactgcaacctccacctccctggttccagtggttctcctgcctcagcctcccgagtagctgagattacaggcttgcgccaccacatccagctaatttttgtatttttagtagagatggggtttcaccatgttggctaggctagtctcaaactcctgacctcaagtgatccacccgcctcagcctcccaaagtgttagaattactggcgtgagccaccacgcccagcctgagagctggcattttagaaacgagacaatcaatgagacaaatgggcagaatacacagtcagtggtgttcagtggtgatgggggcactggtgggaaaaaactgggatgaacaggaggcatggggtagtcaaggaaggcttctttgaggaggcagcattggaacacagacacgaggaaagtgcagacgtgtagaagttttgagaaaaggaaagaagtgcaaagcactgtgagtgggtgcatgtcaggtgtggctgactgcttgagaagctgtggctggaggacagtgactgaggggagaccaggaggctgagagggttcagagagaagggaaggatcactgggaccctgaggtggctgtcggggcctctaccctgagtaggtgggagccaaggagggctctgcccagaggagaaagagcatctgaactaggttctgaccagacccctctggctgctgcattgaaaacagaccaaggggtcataaacgcagaagctgggggatcccaggagaaacctggaacagggcaggcggggaagacagtggcgcggatgggctggtggcagcagaggggactctgggcatattttgaaggcagagctgacagggtttgctgatgaactgaatgtggagtgtgaaaggaataggaaaaaaaaaatcaagaatggtgctaaggttttggcctgagcaactggaaaactggaggtgccgaggagaagcctgtgagaggcgccggggaggcgggggaccaggaagtgatgctggactcatgcttgatgtgctggggagagctctggggcgatggccaggaggcagaggggccagggtggatggggttcagggcaaggggctaagggtagatccagagagtggcagggaaagaggggcattgggccactttatagcattgcagaggaggacggcccacgcagcagccctcctgcccctgcggtcctgaatgaaaccgctttagggaaaaaacaagtctcatttgttggggatgccaaaatgcctagcgggcgcctttccatcctcctgtgtgagagggcgatggggtgccccaagtgtagtgtagtgtagatggggtggggtcatcaggacacagaggccccccagaccctggtgagggtagctgcccaaggctgatggccaggttctggtcctcagctgacctctctacccagctttgtgcgagaagagtgaaaataactggggcgctcagggccaaaccccaaaacaggctccaactgagagccctggcaaggcctggtcttgtaaggagcatgtaccccctgctcccctgacgcattttagaacatgatgcagaagggcagagggcccgccaccatctctgcgaaagtctggaccggatggcagaagctggggctgggaaacaacttcagaactgccagattcaggtgtggaaggagaaaggcattatcccaatggggagaaaatggcactccaatctagttcaccagaaagagctggaaaaggttgcctttttgttgttgttactttttttttgagatggagtctcattctgtcaccaggctggagtgcagtggtgcaatctcggctcactgcaacctccgcctcctgggttcaagtgattctcatacctcagcctccctagtagctgggattacaggcgcccaccaccacactcagctaatttttgtatttttagtagagacgggtttcactatgttggccaggctagtctcaaactcctgaccttgtgatccaccctcctcggcttcccagagtgctgggattacaggcgtgagccactgtgcccggccagctgatgttactttttttttgttttttgtttgccaaaggcagtgtagtaaaattgtgatcggcactccagtatgcttttccttattctttccagcagcccttgatttctacctggcagtccaagtgctggggaaaaagggactcagccagctgctgcagagcaggtgatccacgctgggcaagttggcacaaaccatgtgctttatatgatgattggctcaggggctggcatgtgactcagggtggtccaatcagaagggatctcatgccttgagcattctggaaaaggatgctctcttgctcctgccagatgtggacaaggaggcacacagctgctggagtgccagccaccatgtccagacctccagcctcgtgatatgatcatgatactcgtaaaccacaagatccgactctgcctgctactcacctgtatcttctctttttttttttttttttttttttgagacagagtcttactctgtcacccaggctagagtgcagtggtgcgatctcggctcactgcaacctccgcctcccaggttcaagcaattctcctgtctcagcctcccctgtagctgggattacaggtgtacatcaccatgcctggctaatttttgtatttttagtagagacggggtttcaccatgttggtcaggctggtcttgaactcctgacctcaggtgatccgcccatccctgcctcccaaagtgctgggatcacaggcttcagtcaccgtgcctggcctgtttagggagcaaaaaattcaatgtttttgaagccagctgcagtcggggttcctgtccgttggatctaaagggaatctattgccatgagcatcacacatcttcaagagcaaacagggcagccaggaagtgtgttcccttgctcaagcagaactcacacatcaacatcacctcctcagaaccgagggggacacagccagagtaaaattgctgagtagaaggagatgtccattttcagctttgccagaaattggcaaactgttcttcaaagtggagggaacaatttaccatcatgctgctggcgcatatgatttcctgttttcctacattctcaccaacatttggtgcgatgggacctcttcatatttgctgtggtcatggctgggatgtgataatgcactgttggctgcgtttgcattttgctgattaccagaggctgagcacatgctgccacattttgatccatgagtgcaacttaccatgacattcatcagaacactggcctgaggtgggctgtgtgatgttgtgctattgtgcaaatcgtcatcgtcattgctaacttttttttattactgttttttaaaaattgagaagggatctcactattttgcccaagctggtctcgaacccctggcctcaggtgatccttccactttggccccccaaaatgttggaattacaggtgtgagccactgcacccagccatcattgctaaatttcccaagtgcctaccacgaccatgtaccagacactgttctaatgtatttaatcttcacaaaactctatgagttaagtgacattattaactgtggttgaggaggccaagacacagaagctaaataacttgtccaagttcatgcaggcagaaagcagcagagactggattcaaacccaggcaaagctaatgccctcaaccactctgcagagagctgggaggtgtctcattctgggaacactgtacaactttgacttgtggatatataagtgatcacaggcagggcaacagcacttcaactgctgaactgtgttaaaggatgactataaaacctttgtaaaaactgaggatgtggcgaggtgcagtggctcacacctgtaatcctagccctttgggaggccgaggagggtggatcgcttgaggtcaggagttcgaggtcagcctggccaacatggtgaaaccccgtctctattaaaaatacaaaaaattagctgggcgtggtggcacgcacctgtaatcctagttagtggggaggctgaggcaggagaatcgcttgaacccgggaggtggaggttgcagtgagctgagattacgccactgcactccagcgtgggcaacagagtgagaccctgtctcaaaaacaaacaaaaaaacaaagaaaacaaaaaacctgaggatgcaattgatccttccaagggtattcatatctgagatccaagtccctcaagttgtaagaagccatacagagaaatattcatgaacaaattgatatttatcctgcttaaacttagcttctctcattttgtcttttgtcaatctccactgcaaacatggggccatgcaaagcaagatcactgcaaaatgaaattgcaaatattttaaaagatgcagggtttgtaaaattaattaaaatgacgctggaagatagctcaaaaaacacatgcaaatccactgacgaataattacctggtctataaagatactacatgaaggagaagagactattgagaaggatgatgaagtatgagatgcacttcacaggggaagattcagatgtcagagaattaggagaggcccttgaaaaaattgatcaaatcctcaaatacttttgcaaaaatgtccctagtgaagtaaaggatatcatcttgtgccatccatttcaatttgtgaaacacattatattcctccctacacttcgtcaattcacttgcttgaagaatcaactcattagttgcaactagagcccaatatttgttaaatatcattagatgcaacctaacagagggccgggtgcgttggctcatgcatgtaatcccagcactttggaaggccaaggcaggtggatcacttgaggccaggagtttgagaccagcttggccaacatggcaaaaccccatctctacaaaaaatacaaaaattagtcaggcgtagtggcaggcgtctgtaatctcagctattcaggaggctgagacaggagaatcgcttgaacccaggaggcagaggttgtagtgagctgagactgtgccactgcactccagtctgggtgacagagcaagactctgtctcagaaaaagaaaaaaagagatgtaacataacagagttattctcgaaacattgtagtttcatttcaagatcaaataccttactaaatacattaaaagcactatttattatgaaatgttggtccacttaagtagcatttttctggggtcagtcttcctcagtttgggctgatctcctctattcaaacgagtatcacaaacacaaatggctaataactgttagggtggcctagacttcacttgtccttcagtatccgttttcttcttctcccacagtaaaataactttcatctgggcaaatgtccacctagaataagactacatttcccaggcccctttgctgccatgcatggccatatgacttgtttctcaccaatgggaaataaggagaaatggagtcggagtctctgaccacttcatagagcagggccaccagaacaacttggaattttatttgacatccccggtctctctcacacacacagccaaacttaaatccaactgaaccaactttgctaggtggccacgtgaacacagggtttaacatggctgaagactcagcaggaacaatttacttttggtccttgggggattaaaaatttacagtatattctaatatgtatgtacaaatcaatctaaaaggaaaaaataatctaaaaggttttgaattcattatagatttttgtcatttttcttagtcaacactgatcagtataacatatcacgcagttggatctttaaaaacatttccactttaaacaacaactcaatataaaactcaaacctgagcttcctagctgccagggcaaagagggaaactatacagggtatgtggctcttattatgtaataacaaggagtacaccagttcatcagactaaacaggtgttttcagggtcctgagttctgaaagtaaggctggaatgggattctttgtacagagtggcattctaaatataatgaataaaattctcagtggcagttttacaaaaacgtaaatgttctcggtatctggctctttacacttgacattacgctcccagtcttcatgagggtataataatgaatcatagttgaataaaagcacttatttagggagacagctttttggtgatttgcatacattcaaggacaagtttgggaaatccactttagagaatgtttattcttgaaatgattgattttctcatgtcgcctgtaagattttgaaacactagcctttagctcccaccctgagccctcaaaatggcacagaatatatgagtttcctttcagtctgatgaatactatttccatgccccctctgaattcccatgatcttgcattccattttgattatgccacaaacacctcactttgactctgggcaggtctcttttttgggctgcagtggccctggctgtgaaatgagggggattgatgagaacaggtctagggtctttactgatcttccagcatccaaaacgaaaggtttctgtacagacctttcacccagaggttgtgaaaagagagtctgtgagccacacactcactcctcagacatattttctttggcccccagtatacattaaagaaaaaataagctgtgccggcatattttaaaataagattttcagtgaaatattcagactttaaaacatttcaaggctggtcactcttgagtgcatggctgtactttctagagccaagttgcaggtgcatcttcaataagggcccactgctgtgctgcgggcctgcctgtcctgcttctgctagcaacatccaggcccccgccaatcatctagggtggtggccatggtaacttctgacacatgtggctttctgcagaggctcaggggaaccaacaggtggttgattctgcataatggcacgcacaatacacaggaacaaggtataggaacgaggccttcctagttctcagcagaacatactttctaggtgattctggctatgggatgaggctgtaagaagacacaccttactggcttgctccccacaccaaagcatccctgccagcccacactgtgtatctgagaggaagctgcccagcctcgagggctgcaggtccagcactgcggacagggctggaggaggagtccatccttcccttgcggcactcccacccaaacaaaccccttgtcacttggatgcaacttcctggggttgcaacatctgagccacaatatcttgatttcacaaccgccgcggcttcttacccaaggcggggagtatttatttatttttaattaaagcaagttaaatgaattgagtctggagggttttgcaatggcgctacaggtaagtgactatactgtaattgcatctctacctcagacaaccagcctggcaggtgagccttcagagcccaccaaagacctcctgaaggataagcaaacaggaactgggtcgccctccacccaggatgacacgggtgagtgtggacagtcaaccaccatgtcagtttctgcaccaccttggttactgccacgtagaaagcgaccacacagccccattatctgttcccctccatgaattcccatcccccacccctatgttttggaaccttcttccaagctaatggtttgaagtcaacgaaacagtccctgatgggcttaataactattaacagaggatgcaaactcatgcatgggcaccttatggcctctccacactatgattcatagtttgaaaagactcacttttttgggggactcaaattcctttgacaaggtcactttacatcactactgtaggcaaataaatctgtatttctttaatacacacagaaataaatgcacaactctgaaattataagagagttgctctaggggctatccagaatcaacttgggtaccgcagtggtgtgcagaccacacctagggacgcccgccctggctgtcactcccttcctgcacctgcccccgtccctgctcacctgtccggtagccagtgctattgaggtacacggcaaaggtgcggctctcgtgctgtgcctgccaggagggcgaggagcagttctcattgttggtgtaggtgttgtggttgtggacgtacttgccagtgaggatggaggagcgtgaggggcagcacatgggtgtggtcacgaaggcgttgatgaagtgcgccccgccctgctccatgatgcgccgggtcttgttcatcacctgcatggaacctgcaagtcaagggtggaagtaaggcgcagggcaggagacccgggcggcaccggcaccagggggctctcagcacgtggcatccctaggtctggagtgggcacattctgcagacctacggggcagacggggcaggggccactgctgcacggtgggactgtcctgcataatcaggaaggaccctgggtcccgagtccacctggacactcctgaggtccaggtctggagtctggaggattttgcaatggtgctggaggtgagtgactgtaagtgactgtactgtcactgtccggtactgtaattgcatctctacctgcaaggcaggtaaaaacctgtttataaatgacctgagactggaatcaaactgttttacaaattttaaacacaacattgtttttgcagggtattaatatacattgttttgttttttcttttggaaaccaaccaccatgtaaattgagggaagattatactttcttttctttggaactttcccaataattgtttgctcttactgaaatctggtcatgccaacctggtggcaaaccttctccctgagtattccctggctgaggtgctctgccatcagccacaaaccctgctggcctcttgtccacacttttcttcgagcctggaacccaccacccctcaccccaaatccaacccatcggcctagtaccctctcgtagggagcctctggcaccaccctgggcttgagagctctgagcagtcttgcagcatgtgtcctgagtactgatcataccccaggcttcgaggtttcggtcatgcctgctcttgtttctttcttttctttgtttttttttttttttttttttttttgagacagagtcttgctctgttgcccaggctggagtgcagtggtgtgatcttgactcactgcaatctctgcttcccgggttcaagcgattcccctgcctcagcctcccaagtagcccctatacgcagctagtttctgtatttttagtagagatgacgtttcgccatgttggccaggctggtctggaatttctgacctcaagtgatccgcctgcctctgcctcccaaagtgctgtcattacagtcatgaaccaccttgcctggccatgcctgctcttgtttctcaaccaagctgtaagcagagcaagacacttaggaagaaaggcaagaaggaaggaaggaagcaaatgaacgtgtgtgggagccctactgcgtgcaggccaaggtcccaggagggcaaaggctgtgtgctccgctcagcgctgaatcctcagcactgctgccgtgtgtgacacacagtgggtactcaacataggtgtgacgagtgcatgctcaattgtatgctgtggttggtacccagacccttagtgatttgatggaaatattccatggaaaccctctctccttcttctatggccatccttggtttttccccttttccttgcagttcttaaggtgtgcagtgggttgaacggtgcccccgtcccctaaagataagaccatgtcctaatttctggaagctgtgaatgtgaccatatttggaaagagggtgatatggtttggctgtgtccccacccaaatctcatcttgaattgtggctcccatatttcccacgtgttgtgagagggatctgatgggagacagttgaatcatgggggttgtttcccccatactgttctcttggtagtgaataagtctcacgagatttgatggttttataaaggttttccctcttgcttggttctcattctctcttgcctaccgccatgtaagatgtgcctttcaccttctgccatgatcctgaggcctccccagccacatggaactaagtccattaaacctctttttctttctaaattacccagtctcgggtatatctttatcagcagcatgaagacagaccaatacagggtgtctttgcagatgtaattaaattgaggctactgaaatgagatttgttctggattccccaggtgggccctaaatccagtgacaagtgtccacataggacacaaagtggagaagacgcacaggcacagaggggaaggccacattcaaagggaagcagagactggagggatgcacatacaagccaaggaacaaggaactcctagggtccccagggctggaagaggcaaggaagggctctcccctagagccttctgaggaagcacagccatgctaacaccttgattttggacttccggcctccagaactgttgagagagtaaatttctgttgttttaagccacccagtttgtgatctgttaggacagcagtgggaaaccaaaacagggtctaccaggcatgtgaaggctgtgatcccaatcacctagcaaccccctagaaacctgaaaacaagcatcagacccactgcagcctcctgggatctggggaaggccctctgctcagcaatcagctgcttctactttaaatttttaccaccaatcaaggcaccaaggtcgtgcccctgaggtcccagtattgcacattggccgccctcccacctcctggcccctgcctcagccgtacccccagcctgggatgctctcactcctccaatcacagggctacctctgtctccttcaagttattgatcagacaccaccttcttggagaggccttccctggcctgtattgaaaccacctcccgcaacccatagcactctccactctgcttccccgctccgtgtctctccacagcagttactgtcctcaaacataagtcattttgatttcacttatttgtatgttgctgccttcaccacaagggcagagactcagcctactttgttcactgcctagcacagtgcctggcacataatgtgctcaacagagaccagctaaattaacatataaaatactatcttacactcgggttttcatatctcaggaatccaaaccagttggtgtccacagacctgtgtgttggtgtcttgtagagtgggttttaaaaatgtgacattaaatagcatcacacaggatatgtgctctccagtttgccacactcccccgtgctccctacagtcttacaccacctgcacccactctcattacctgcccgacccctgaaggcttgggtgttgcaaccttctgatatagctaaggaactgagagcactccaacttattcctggggaagagggcagtcttctatgccagtaataatcattataattaatagtggcgactatcactggctgaatgcttatggctgggctgaagacattcatcacttaattctcccaatggcccatttgacagaagagggaactgaacctggggagctgaatgactggctaaggctgcacagctgggaaggcagtgaagactcaagcctagcagaggcggggtgctgagtttcacgttcacaaaatgtcacagtcacacgggaggtggtaacagtgtcctgaggaagtgcatagaggtccccatgctcttggtccactcttggcttcagttaagctcagaatggtcccttggtgacccagaagggggtcctctagtggtgacttcatcaggcacaccaggggtgggggtggcccagggtcacatcaccaaacaccagggatgctggtggtgtgaaaggccactgggagctccaggcagggggtggcattgccttagattaattgcgtggcttggtttccttctacttagggcaagtaaccttagcttttcctttagggtggtggaaatcctcttaaaacaacaacaacaacaaacaattgcagccgatttttaaaaagtaaataatcgtacaagtggcacacagatatatgatgaaaattgtgagggaatgattagaatttggcaatcattggcttggtaaaacccggacctgacatcccttgatgtgtggcttggtacaaccctgacatccattgatgtcattcggctgtcgattagacctcaggtgccacacccacagccaagccctgatgtcaccgtccctcctgctcctcccgaagccactcccctttcctccgggtacttgggcaatcatcttggctacggttcctcccatctttcagttcccacatccaatccatcagcaaagcctgttgccctctcttcaacgtaaacacccacgatcgtacccttgccacctcccccgtgggtcaggcgatcatcctctctccctgaaatcaggccagttgcttcctgattggactccagtcacttattccccacggtgtagccagagtctcctctcctgacactctccggggctcctgctcactcagaggagcccaaatctttctggccatccacagagtgtggtgggacccaatcccctcccctccctaaccccatccccctctccgcccactctctgcagccacagggtcccctgctctgtccacagactgaccaggcgtgctcccatcccagaacctgtgccctgctgttccttctgcctggaagacctctcccccggagccccgcagcggtgccctcacccccttcttgtctttactcaaaagttcccttctccgtggagtcttccctggcccccaatattttctactcccttccttgcctgacattttcaaccctgcactcatcatctaacacatgatatacttttatgtttttatctactgatcccgtttgctgttccctgtgacttttgatggctccacagctcagcctagaacagtgcctggcacgcagtgggtgctcataaatatttcttaaatgcacgagtccagggcaccccaagtggaatcgatcctttgctccctagtcccaaacacgaaggagaaaggacgaagcagctggtagtgagagctcagcctctctcggtctccagaccctgcagaaaggacaaaagctggccacccacctaactggtcagacccttctcctggaagggaacgcagggcaggccgtcacctgatgaaatcacctgcactccgcagcccccagtgctgccttggcaaacagtgaacagcctccagaaccatttcttgtttttaatgggctcagatccagggtctcgaaatgcttagatctccttcctcctcattccagaggaagcgagctgtgaggtgctcttggccagcactcacccttcccaaatcagctggcggaggagcgctgtgtcaatccacgagtaaaggacaacagtgccccggaatgacagcagcatctgtgcatgggcagtgctatgtgctaagcctccccttggggacagtaacctgctttattaaaactgccatagcgacgaggctgtgtaaacctacctctgtaacacaaaaacatatgatctcatccccttgcccagccccagccctaatgcagaaggacagctccgacgggagggaaggacctgaacgacacggccacacagaaatgaaaaggccagttttcaagcttttcaatgcagctgggccagccaacctcaacttctttcgtccaacataaacctggggacatgcagacaaaaacagacccggtttctttccatgaccaaaccttcccaccatactgggttgagggtgaggtcactctgacacctctgtgactctgatgggctggagaggcctcacccccaggcccatctgttgggatttaaacttgggggcccaaaccacccaactgctagaatgcagtttctcccatgacactcctgaactgcctccccattcacggtggctttttgggggcctgtgtaccactgtgctatgatttgtttgatatttgtatttaacgtgatttaagaaaaaaccctttaatctcaatccaagttaactacgtcgagttagagaattaaggtgtgagttatatatatatatttttggatgcaccatccagtaagtccatcgttgataaaatcaatattttgctgacctgccacagatgacgacgttgccagtgtcataggaaatgctgaatgaatttgctcttctaaaggtctaagtcagagcaaacactatctatggggacttagcaaggtgccagggagtttcaggattcaaaacatgattttttttttttttttttttttttttttttgccattcctgaggcttaggtggctcctatctgttggaggcctgcttcagctgggagcaggggaaccctgtacccctcccagacaaatccctgcggccctcaacttgggtgattttgatgtataactagtgagatgccttcctatggctagtttcttaaaattatagatattattagagtctgtgatggcagggcctcctagggaaagcagcagaaggaagaatggggcagggagaaaaataaaggcggagtcagtaaacacaggaccttgacttaaattcactctaatcactgttttctctgcctggactattgcagtaggctcccaagctgttctattctccgtttggtggccagaggctttttcttttgagacagggtctcactctgtacccaggctggagtgcagtagtgtgatcacggctcactgcagcctcgacctccccaggttcaggtgatcctcccacctccacctcctgagtagctggaattacaggtgtacactaccacactcagctaatttttgtattttttgtacaggtggggcttcaccacgttgcccgggctggtcttgaactgctgggctcaagtgatcctccttccttggcctcccaaagtgttgggataacaggcatgagccaccatgcctgcctggccaggacttcttttaaaacagtcagtgaaatcatcatattcgttgctctttgtcttccagtgactgcccgcctcactcagagtaaaaatcaaagtcctccctctgtcctacaaggtcctcagtgatccggatgctcactcgccccaactacaactcctactgtgcgctctctctctaagcttcctctgctccagtcacattgacctcctccttgttgttcctcgaacacaccaagcacgcttctgcctcaggacctttgcacctgccactcctcagcccagactcagtccctcattgccttcaggtttctgcaaatatcactttctcagcaaggctttctctggactgtgctgattagaatcatgccctccccttccttcttgccttttgctgctcttcctggtgcttccgtgtgagtaaatgaagagtaaacattcttaggggacatgcaggctacagattcttaggggacatgcaggtgcctttggggtgagtggggtacacggtgggtggggagtcaagggctatctctgctttgcattacttggatattttaaagttttgcttgtgtaattttattgattgttttgagatggagtctccctctgtctttcaggctggagtgcagcggcgcgatctcggctcactgcaacctctacctcctgggttcaagcgattctcctgcctcagcctcccgagcagctgggattacaggcaagtaccaccatgcccagctattttttttggtgtgtatttttagtagagacagggttacaccatgttgaccaggctggtcttgaactcctgaataaataaaaaataaataaatgcagcaagagggccacaggtttctagaacaatgggagagggcaggatttggcacttggcattcctgcacgggtctgcaggcctgtctgtgtgctacccctatgtgaagcaggccctgggatttaggggaagagggcacacagtgggctttctatagatgaccgaaaaatctatagatggtcttgaactccagggctcaagtgatcctcctgccttggcctcccagtgttgggataacactgttatccactgtggccactgttgtggccacatatcacctgctacactctacctggggccagtctgctcccaggggcccccaagctgtgctttctttccttgaggagaggggcattaaagtccacctggcatggggcaggctgaggatgaagggggcaccacacacccctctccaggccgcgtccttctcctgattcctctcttacctgttttgttttgtatgttaaaagggttcagctgctacaaatgaatatgtgtgtgtgtgtataacacacacacaaacagatgcacatatacacttcagtcctagactgaatcaccaggtcctttttcatctgtagactttgggtgccaaagagcactgaattgagaggccaagaatgaggtgtgaactgccgtaaatcactgactttgagcttcagcttccctgtctgtaaaaacacagcccataaataactttaggtataaggtttgactatgaaattctaggatagattctagaacctatcgctatgtcaccatactcaataggatgaaaaaggttttcagtcagaaggcctgattccaaatcttgatttctgccacttcctattaaccaggtaccttgtgcaaatgatttagccaccctgcacctcagtttccccatctgcaaagcgggagaataacagtgcctccttctcagggttgttctgagttttgagggaaaaaaaaaaaaaaaaaaaaaaaaaaaaatatatatatatatatatatatatatatatatatatatatatatatacacatacacacacacttttttagttcaatgcttgacatacagaaagcacttaatgcatgccagcttttatttatttatttacttatttgagacagagtttctctcttgtcacccaggctggagtgcaatggcaccatctcggttcattgcaacctctgcctcctgggttcaagtgattctcctgcctcagcctcctgagtagctgggattacaggctcccactatcattcccggctaattttttttatttttagtagagatggggtttcaccatgttagccaggctgttcttgaactcctggccttaagtgatccacctgccttgacctcccaaagtgctgggattacaggagtgagccactgtgcccggccacatgtcagcttttcaacaagtatcgtctcacgcggagttaaaaaacggagtccctctagactaaatcttgtctgcatgtgtgtttgatttaggtctgcccaaaaggaaaggattttaaaaattgaatggcctttttctttaattgcgagatttcacatcaattcagctttctggctttgcttgaaaaatgcaaagacctggctttgatgggcccacagtgggctggacctgagtagcgaaggcccacttgacaaggtcctcctctggtcttccaccacccctaccatgccgacttcctccttgccagcacgtgcctagccctgtgggcatggagtttgcaacccttagctgattcaattccaagtgaagggagcagctaaataaatctgcaaaggtaacgctctactggggcccagagacctgcagagaacaggcattcagtggggaagagaggctgtggggtcaggtacaggttggaacagagtcttgacctggacaggtgggggatgaagagggctatgaggtcgagccacaggcgggaaagaacctgtgtcctgcactgacctctggctactggtgtccacctaacaggctggaactcattcagcagccctctcctggccctcaaatgtccctggaatgtccgcagtgctgtaggatcagcttgtgagctccctgccatgaccaaggcaacacctgctaatgggctgcagcaggctgggctccatcagacctgaccaactgccccagaatagctctgtctccagcagaggggagagaaaggcctggggcacaaacagcagaaatcgggagccacacttgggcaaaagaaggatgagttcatgtcctttgtagggacatggatgaagctcgaaaccatcattctcagcaaattatcacaaggacaaaagaccaaacactgcacgttctcactcataggtgggaattgaacaatgagaacacttggacacaggaaggggaacatcacacactggggcctgttgtggggtggggggagaggggagggatagcattaggagatatacctaatgtaaatgacgagttaacgggtgcagcacaccaacatggcacacatatacatatgtaacaaaactgcacgttgtgcacatgtaccctagaacttaaataaataaaaaaaaaaaaatatatatatatatatatatatatacacacacacacacataaaaagggaatctcttatttttcacctagtatagatgtgctcactgctgctggtggcaactcttgctgtgcctgtaactcaatccagaataattacactggattctggagacctgttgctcagaggttgttgtttttcttttgttggtgcaaaggtgaaccattcctgactcttggacattacaaaataaagacaaatgttattgctggtttcagctacgaaaagccaaggctccaaatcggttcctaaacccaaaatcaattaggcagatgtcgaggaggcaggactgagattctattaataagcatcgggttgtcagagagaccatgcagttaattttttctccgttgctttctgctgcctctggttgcagaagttcctgggagaaaattctgctatggtcatcgtcaaccatagcagagaggtggcagagcacacgtgggaaagggcagggcttgggtgtaattgacgaggctctgcaatgattggtcatttcctctctgagaaactccacccagaaatattcctctaactcaaaatgctacaatcaccatccctgggaggggatatttattcaatggggcagggcttccagggtgttttccccacttttcagaaggggctacgcagagctgctgcccagccacaggcctggtgggtgatgtttgcaaagcaacctaatgtcccccccttccccacctctcccaatctgttcctcctgcccccgccttcccatctctgtaaatggcactgccatctgcccaacggctcagccaaaaacctaggagtcatccccgattcctcttccctcacccacccactcacgatccataaagcaaaccctgccgaccttccaagcagcaccggaatccacccacctctctcgctctgcagtgccccgtcctgctccgtaccaccagcatctcccacctggactgctgcaaacaccacctgatctccctgcttccgctcttgtccctgggccaccctcttcacctacagccggggtgtgcctctgagaacatgcacgcatagctgaccagctcagaacattctggggaccttccatcgggcatgcaatcaaatccagaccctgctgcatggcctgctggggaccaccaggtctcccctgtctgctctctgccgccctcttccccatcctcctccccttcattcccatgtcctgctgccctcctccaacgtcctgggaaacctgttcctgccacagggctcttgcacgtgccgtgcttctgcctgcagtgctcctgcctcgggtttccacatgaatgtctcctcatgacacaggtctccccagtgttaggccacacaaccccacttcccactgctaggggagctgccctcactgggacccttgctcctgatctctggtgttgctgagaccctcagttgcccacaaatatctctttctccttcttcctctgatcaggctgtgactttattttcaatgcacccagctaggaaacatttcccagattcccttatggccaaagatgtgccaggagcctgcctgccgccttccagccctgctctctgtccagttctccaccccagggcactggcctggaggtgctggttcaacaagccccttcgctctctgggctttgggttggatttgactgacaagggcccctggcaggagatcggagaaagaagagagtgaggttggtggacagattcctccaccttcctctctgtggtgccaacagagggtgacagctcttgtggggtgaccctctgtgtccctgggttccagtaacctcttgtcccactgttgctaattagcctggggcactgccctatccctagtggtttcctcgcacttgctcacaccttagcaaaaaacacttaaaccgtcttccaatgattcaaatttgcatgtgctttataattctcgctgagatcatgtggctaagtaaataagatctattcgtgttgcatgtgacttctgaagtggtttttttttttttctttttcctgcccttctgcctctgcttccttcttcttgctgcctagagtgtggctatgagagctggagctccagcagctgttctaaccacaaggtgactttgcagatggaagctacgcagtaagtatgatggaacagaaaggcagagaaggagcttgggtccctgataaccttgaagccaccaagccagccctagactgcctacctccagacatttgtataattctgtcttgtttaagccactgttattttatgttttcttttacatgcagccaaacctaatcctgatacacttaacttccagaactcaagtgatctcccaaatgttgctgaattgaaaaaaaatcatcttacaggaatgtgcttggcaagctgaacaccagtgtgggtccgaatgagcctctcttcttcctgagataacctgcatccacatgttttttctcctctagtgatcagcggctagaaggccaggaggtgggatctcagagaggctgagctggaagttaccactgatctggtgtctggaatctgggtatgttgtcctgggcttccagccatctggcccctacagagagtacttgagcctgcgatttggaattgatctcctggatatcaggctgtggcacagggtgtggtttccttgtgttcacagatggaaagtggaaaacaggaggccggccagacctctgctacatctttctttcaaaagcctgcctctcccactggacagttctccaggctgtattcctgcaactttcaggatctggggagggtctcagattcagtaaagcacaaacaagcacacagtttgtatacgatccccaccgtgccctactctaagtccacccaggcctgggcctctctcttcaacgtctgactgatgtggctgcctattggacagttcctgttggcttttcacaggcacctgcaacttcccaggtccagaactgagctttatttattgatttattgatgtattgagacagagtctcgctctgtcgccaggctggagtgcagtggcgcgatctcagctcactgcaacctccgcctcctgggttcaaccaaatctcctgcctcagcctcccgagtagctgggactataggcgtgtgccaccatgccccgctaatttttgtatttttagtagagatggggtttcactatgttggccaggatggtctcgatctcctgacctcttgatccgcgtgccttggcctcccaaagcgctgggatcacaggtgtgagccaccgcacccggcccacagcttctaaccatggttttccccatctctgtacacagaaaatccattctcatagtttttcaggccacaaccttggagtcattctcaactcttctttaccatccctcatcagttccatcagcacttgtatcagctctacctttgaaatatgaccagcacttactactttcctcactctggtctgaaccgctatcatctcatgcctggaccattgcaatagactcctcattgggctcatctcatgcgtggactgttgcagtagactccttactggacaccctgctctcattacacctattcagtctattcttctagaggggtcctatgaagacacaaatcagatgctcaatgtcctcctctgctcaatgtcctctattggtgtccatctcactcagaaagccaaaatcttcctcccattcaaaggctcatgccttgcacggtccatccaaccaccacctccctattaccgttcattcttcctgctgctcttgtgcacgctgctctggcctctttgcggctctgagcctgctgagaccgcatctgcctcagggccttagcacacaccgttccctctgcctggagtgctcttccccagggatcccccttgactggtttccttaccttctttgctcagatttccccttcccaatgagaccaccctatagaaaatcccagcgattcttttctccacctttctcctggttgatcgcccctcctggcttcccctcctggctttattctcctcctcactttctgctcttttatgtactatagattcgatgtgtcttgttaactcttgcattagaatgtaagctctgtttagtttgtttgctgttggatctcctttggcatacagtaggtgctcaggaaacacctgccgaatgaataagtctggtccacagtttgagcagctgcttcagagagcgccatgtgagggtgtcacgagcatctctctaactggactgcacaccagctacctgccttcttctggcactagcttctgaattttcctttggggaatctgctctatcccaatcccagtcctcatggttcaagtggggttggctccagtcctggctccaggaatgtgcacctgactccatctggccaaccactgtgttccattcccctgaatctggttgaccagaagtcccagacagtgtcagaccaaaaagactcaatttgggtactctcttctaggtgagagaagctctctttccacagggatggcttgcacctgtatggtgttcatgtgggtctagtgatgccaggaatgctgcctggagagctggcctgagagtaaagccaacttggaggaaagctgaggtcagggagatggagggacagaggccacccagagacaaagctcctagatccagccgcacctgaagctcaatgtatacttggacttattcatatgagtccaataaagtcccctttttgattcctcaatcctgctcgagttgggtttacatcactcgtaactgagagaatccaggctgacagagagtggttgtgacacacgcgtttttaacacccagtggaaggctggttcccatggcacttttgcaggccccaaaaccaccactcagttgcttttcaacagccatgatggtgcaactctgttcatcagcagaggcagtaatggcagaagaacccatgccaaacttgattgacaagtgtcactcaaattatggggtatgtaaccatgccaggctcacatacctggcagagtgggtgccagctcacctgcatgagcgtggacagcactcaccccactgtgtcagctgggaggagactctaatgttgctgttcagtgccatgagacatttagattttaatgtcgttttgatatgcaaagcttgctgtagacaaacaacactgtggcattggcccagggtgctctaacagaggatggctttaacaacccaagtgagagcaaactgtcacacatatgacaggtgccaggtattcctcacaagaatgccagggaaacagatcatcatctccactttatagatgagtaaactgaggcacagagagggcaaatctttcccaaggacacatggtcaatggtagagtgaggatttgaacctggtggctaatgagacagctcttacccttgcaactttactcggagtattttcatttaaagatgttctgataggctgggtgcagcggctcgcacctgcaattccagcactttgggaggccaatggggggcggattgtttgagctcaggagtttgcaaccagcctgagcaacatggcaaaagcccatctctaaaaaaaaaaaaaaaaaaccccaaaaactcccaaaattagctgagtgtgatggtgcgcacctgtagtcccagctacttcgggggctggggtaagaggattgcttaagctcaggaggtcgaggctgcagtgagtagtgatcacaccactgcattccatcctgggtgacagagcgagaccccgtctcaaaaaatataaacaaataaaaataaagatgttctgagaggcaaagaattcttttgaaatgcaaacatcaggccaggtgtggtggctcacgcctgcgatcccagcattttgggaggccgaggcggcggactgcttgaggtcaggagttcgaggccaacctggccaacatggcgaaaccctgaatctactaaaaatacaaaaattagctgggtgtggtagcgggcacctgtaattccagctacttgggaggctgaggcaggagaatcacgtgaacccaggaggcagaggttgcagtgagccgagattgcgccactgtactccagcctgggtgacagagtgagactctctcaaaaaaaaaaaaaaaaaaaaagaaagaaaagaaaagaaatgcaaacactggatgcagtctcgtggggcacacttcaaatccgacaatctgaggggcctcgaaaaggcacccatctctgcctggtgtgaacactcaggaaaatgagcactggggaatccgctctgatattctggggtttggagtctggctgtgtccttaaccctctgatacaagagccaccaccaagtggtccccatgtaagtgggacccccacatcaaaagcttgagaaagttcttctcttttctagtctctatcctgctgatgaggccaagaagaaagtcttggcaggtgctacttcacctttaatgccgcttctgaaactgcccgtcaccctcattacagtagagacacactggctttctgggaggcagcatcttgctgaaatttaaaaacacgacttggttttcactgtgtttggttttacagtgatcctttgccgaaggcaatgggtattggttttttcctttacagtcagaatttggaggttccttttaaaataatatttaagcttcaaaaataagtccagttaaagaaattctcaagtcatagatcagaactgggatgctgcaaaaattctcttgctccaggccagaaccatgtcttaatcctcttgctgtctcagagcctgctggagccccagaggctccccagaggtttagatcaaattaaatcagtaaaccctggcagagcccaaagattctactgcctccctgaacaaaggacgtctgcaaacgagacctttacctccatgtgcttccctcttattcttttggagcggaagtccagcaaaagtccgttggtctcagagggccattgagacacagggatgtccccaactactttaaacatgtaatgataatttaggccacttacgaactagtatggccctggaagcagttcccctgggcatttgataattccaaatgacagcttagggagtcaaatgcgtgcagggaaaggaaaattgaatatacgtggtacagccccgaaccccccaaccttgcaattaggaaacagaacaagcccctcgtcttgtgtatctggcaccagtcctcccaaccggaccctaatgaggatggacgtctgttctctgtcctgggactggaaagaatcctgggattatctcagtcaagaagtctccagcccagagggctgtcagaactgctgcacggatgggcagaaaatagcaaatgataaattttttaggaccacccgctgcatgccagttgtagcagagactgtgagataatgtattgggcttttttgggacatgcattattgatctgggtctgtctagtggtttataaaaagcctatcatgcccctcccacaaccaccttcccatcccttgcctccttcaaaacccagtgctgctggtggaagaggtctggcttgtttatagagggcaagacttgtaggccctaatctatgctgtgtagtgctattgggcaagagctgacacaggccactgaacaccaggggctctaaacccaccgcatccacctcctagaatttatccttcagaagcactcccttgtctgtgcaacgatgcctgtttaaatttccagcaacaatatccgtaacagtgaaaaactaacaaacgcacacgctaccaatctgaaaacaactcaatatccatcccaggaatctggctaaatagagcagtggctaagatcacgcgttctgggttcaaatcttgtttttctctttttttctaagatggggttttgttctattgcccaggctagagaacagtggtgtgacctaggctcactgcagccttgacctcttgggctcaagtgatcctccacctcagcctcccattagctgctactacaggtgtgtgccaccatccttggctgatttttacattttttgttaagacggggggggtctcactatgttgcccaggctggtctcgaactcctggcctcaagtgatcctcaggctcccaaaatgctgggattacaggcgtgagccactgcacccagctcaaatcatgtttaatcacattctagctgtgcaaacttggacaagtgacttctctctgcctcagtttttccatctgtcaaatggagagaagaaatctctgtattttaagtcagccacggctttctttgttcccctctctcctgtgtctacttcatacctgctattggtttccttgtatctgcatacgctgttggtttccttatatctgcatatgcctttgctttctttttatctgcatacactgttggttttattcacaagtcacagatgcaaaattcagtcagattcagacatgagacttagctggatcatgttgcaaaaatgtgttgttcctaagagtgggtattcagccactcacctgttgattcgggccccaaatctagcggctgcccttgaaacgtatcttttccataacccacatacctaacccattgatcagtttatttcccaaatatacatcaggtgggaccgcatctcagcacccgggtctgagcttccatcatcactgccctatcaccccatcggcctctgaatgagtgtcctgtttctgcccttacccctgcgatttaatttcatcaaaagagctgggggatcctgttagaacctaagtgaggtcacggccttcctcttcttaaggccccctcatccatgtctattttactaagaatcaaactcaaagcccccaccatggccacaaggcctggtgcaacccgggccaagtcagctcctcagcttcatctctctccatcacggccccagctccctccactccggctccctggcactttttttttttgctccaaaccaccgagcccatttctatctcagtatctttgaatttcctgttctcctcacctggaatgagcctcccttagttctctggctcctgacacagtgcactgaatgcaacaaatgcgtaataaacatctgctggatgaatgaacaaacgtgcagggcatcggaaattctaagcatgactatagccgaaacagcgtcggggctacacaatgtgagaccaagaagctctgaggtccaggtgctgcctgcaagacccctctgcaaaattcttcaagaaacgaaacacacctctctggccacagtctgcagactccccatagttatcaaatgcgcctcattctaaatgctgccaggagataggtatcctatgtgtcaaattgtcaataaaagctctgggctctgattgcttcctggctacaaattctttctgcactgagaagctcccggaggaaaaaaactatacttgtgatcattaatacaaagcattgcaaggaacaacttggttttatgtaaattgccttttcctggtagctaaaagacaaattcaggttgtcaaggctaacctagtcaaccttcacatttgttgccaccaacaacacgctgttatcctttaagagtggacagaggctgagggatcacccttcacgggatcaatgattgacagtctttgccacaacccacaagagcctccaaaatttggctccaggctcatgtctcatcttttttttttttttttgagacagagtctcactctgtcacccaggctggagtgtagtggcatgacctccactcactgcaacctccttctcctggattcaagtgattcttgtgccccagtctcctcagtagctggggttacaggtgtgcgccatcatgcctggctcatttctgtagttttagtaaagacggggtttcaccacgttggccaggctggtctcgaacccctgacttcaggtgatccacctgcctcggcctcccaacgtgctgggattacaagcatgagccatagcgcccagcctgttctctttaactctttggagaaatccaggaacggttgtgcaactggagaagggtagagacccctaaccttgaggacccagttgtgaccccaaacacgtgtgggtggcccgtgtcttggtttcaatgtactcaaaagtgagcacgacgcatcaacaccaccgccttgcctcaggagcctcagcctaacccagggaccctgctccgaggggccgaggtgccaccctggggccccgaggcttacccagctccacatcctggtcgtccgtcagcaccaggatgatgttggggcggatgttcctgcggtccctctgaaacctgcctttcaggcggtggtgcgacaggaaggccgagcttccacccagcagggagaacacagttgcggacagcaagcacagcacgaggctcggggggcccatcttctttttttgctgatctggtgcttcttttgggatgcgggagtctcaagttgcgtctgtggctttgtttcttttccctcgtccctcttcactcgcagatctagaggaggaggaagaatcaggtcaatatttatgtcaaggctgccggctgctcattcttgcataatgatttgtatggcggctggcatgaacaatgggagtttctttgaacaggggtggctatggcagagtgaaaaccgaactccgctgaagttagcaaagtctttacagtttgcttggtcaacagactggcagaaaagccttctgtggccacttctgcagaaacaatttcttccctggatccagtgagcctctgatgtgtcggtggcagcccaagacccgagtcagataacagccgtctctgaataatccacccaactccacagacaaatcgtccccagggagaggaacagcagcgggctggtctcaaggggtgaatatttgccgtcctcttgcatctgcccgcaccgtggggtacagaggtgagggagatgaagttccagctccccagcagcgggggattcaatcaggggtttaaacgagagcctggagctggatgttttgggctggacaactggcatgtgtgagtggcagatcttccactcactggctcagttttcccgtgagcaagcccgtttggaacctcggtttccccatgaacaaaatgagtagacagggctgttgtaagatttcagtctgctggggatgcgtgtgaaagccccttgttaagggatcttgtagttgggcaaaaaagtattcctttttttttttttttttttttcccagacagagttttgctcttgttgctcaggctggagtgcaatgacgccatctgggctcactgcgacctctgcctcctggtgttcaagcgattctcctgcctcagcctctagagaagctgggattacaggcgcctgccaccacgcccggctaattttttgtatttttggtagagatggggtttcaccatgttggccaggctggtcttgaactcctgaactcaggtgatccacctgccctggcctcccaaagtgctggggttataggtgtgagccactgtgcccagcctattagttttaagttgcagaataaatgaaatgacaatagagaaaattgagcgctaaaaggtggagggggaagacctgccacaggccactgtgccctcagtcacccccctggccccaggtcagactaggtcaccagcgaaggtgggtgcggggaggtggggacgcgactctggctcaagcaggtctctaatctcgccctgctctttgctctccgtggtcattttttcacttcttgaggaaatgagccttcaagtcctgtccagatatagacttttggtatcatttatttaaaacaagagagcatgagcgagagagccacagcctgcagatgtgccgggaggaagccaagtgctgtgggggtggctgtgttgctgtgaccttgaaagggtctgtttgtccttgcccttcatggggaaccccagccatcagctcaaagtcatgactcagaggctcagcaaggtctccgggttcagcagggggatgtgctgcctgcttcatctctcctggggactgcaaggtggcctgaggggtctcccgcctccctcttccctgcccccatcctccattttcccagggcagccggaggaatcttcctaaaatacagatcagatcacagcactgggcaggggagggcacagtgcctcgtgcaggtacagactgaagggggtgctcgctcccaggctgcacaagtgccaggcactcgcctcaccttagtgccagtcctgtgctcacctgccgcaccttccctggctgctcatggctcacaggataagatgcaaacttcttgccagggctgccctggcccgtgagatctggcccctgcccacttctcctcgacctctcctttccagccctactggcttctttctgtcgaatggacaagtcaagcttctctttgccccagggtctttgcacctgctcttttaaaaataactcccgcagctgtgcgcagtggctcacatctgtaattccagcactttggcaggctgaggcaggtggatcacctgaggtcaggagttcgagaccagcctgatcaacatggtgaaaccccatctctactaaaaatacgcaaattagctgggcatggtggcacatgcctgtaatcccagctactcgggaggctgaggcaggagaatcgcttgaacctgggaaatggaggttgcagtgagccgagatcatgtcattgcactccagcctgggtgacagagtgagactccgtctcaaaaacaacaacaacaacaacaaactcctgctttgtactcctggctctttctgtcaaaagaacaaacgtcatcacctcagagaggcctgccctggccaccctatttaaagcgggggcccccaacccaggcactctgcattttataaccggttttatttctcttgtaatcactactgcagcctgcaatttcttatttattgtccaattcttccccactagggggtcagctccctgaggacagagacaggcttatgttattcatggctgtctccaggccttggcacaaagaaatagataaataaaggaacggaggttctgctaaggtcctttgagttctgcagagtgagggaagctggacttggcagggccgtgccatagcttgggtctacatggctcagaggcgtccatcactgatgccttgccccagccaccctccatggacaccaacgaggagctggccactgtgttctctgggcagcgctatggttgaaaaaccccaggaagggtcactcctgctccatttctcccccagctctgcttggcaccctgggaggctgagctctacagatggcacggtcggcacgtccctgctctctggcttccggctgggaggctgcagcatgggaggtggtgggaagtccgtgcatttattctcctcccgcacgcagtagctccccaggcagtagccttcgtgtctgtgtgtgtggatgcagctcctgcctggggcccctcctggctctagcgtctccccagttctgagttcacctctccctcctcttgccccatcaagtctcgggaaagtaagggctcctgttgctaccggttcctcggtgcagcatcatttctttgctccctttgcccacctgcctctgaaaacagtgctttcaatcaactctcccagctgccctgatgcgcaccctaatttacttcattcagggacctgtatcctatgtcaggctggccaggacagcaagtctcccttctagcacctcccctgggagcaggaagcaggctccgctcaatgcctccttcccaggtggctctgagagtcacaatttcaggggagctggggacacactcgatgcagtcgtctgacatgagaactgtgagtttcatgggaccagagggtgaacaacaccttccttctcaatctctcgtctgcagaaacatacacctcatgacagccagagccactgcggcaactgcctgctgggcacctgctttatgccacgtggtgtgatggttaaggatgtggactttggagttacttgctgaaagaccctgagctagtaacttaacacctttgtgcctcagtttcctcatctgtgaaatgggtgtgcaggattaaatgtgttgatacagtgtgctgggactagagcctggccatagtactaactgggatacatattccacaatgtaaaccattattagagtgatcctaccgctgcagctgtcctgcgtcaggcactctgaaatctccttcaacctccaccaaggctccctcctgcaagtactattattagccccagagaaaactgaggtttcattactgtcctaaggccacccagacagaagatggcagggatgggatgtgaattctgccctccctcaccgttcaatgtgggcttctcatcacgaaactcggatttcccaactctttccgttcaaggaccacggccctgatttctgctgaatctgcagagcccttcagtgattatttgcttaacgtgcttctttaaatggcctcattttaaaataaaaacacaaacacatgttttgggaaaagaaaacttcctacccaaagataaatggaaagtggacatcgcttccctgtagagctaattgtacaaataaaagtcaaagaaagctgaatcagtggaacttgatgcaaatagcttcccaggcttcgcgtgccctcgcgctcgcactctcttttgaagtgagattagcaggtgttgaaaggagtcaaagcacattagcaccatctgagactttctgctggaggtaactggaggctgccagacagctgaaaaggagacaaactctagccatcgaatcagtccctgaaccaccccaaatcagagtaatcctcaaactatgttgtgtatctgatatggtttggctgtgtcctcacccaaatctcatcttgacttgtagcgcccataattcccacgtgttgtgggagggacctggtgggagataattgaatcatgggggtggttcccccatactgttctcatggtagtgaataagtctcatgagatctgacggttttataaagggtttccccttttgcttggttctcatcttcttttgtctgccatcacataagacgtgcctttcaccttccaccatgattgtaaggcctccccagccacatggaacaatgagtccattaaatctttttcttttaaattacccagtctcgggtatgtctttatcagcagcgtgaaaacagactaatacattatcagtggcccatgtccctccatcgggaaacactacgggatgctttgcacttgaaactacgattgcagcagccagcgttctaagatgcacattcacgttccttcagagagacagacgtggagtgctaatattgggagaattccgatggggtgccctacaaatagcaactctctgaaaccagaaaccaatcacaggaaaacctttctgaaagcttgcagcacactccagtctctgctctgagctgtttgcaggtgtcaacccaattaatatgcacacccacccatcaatatttcacccattttatggatgaagaagctgaggcacagagagttaaaatcactttcccccgatcatatgggtaagtggcagagaaggggttcaaacctagtctggcccgatttgggcagctcaaccaggaccccctagaagcagatctttgaacaagttcctaagagtctcccagcctcagtttcctcatttgccaggtggccaggtgccctctgagggcctttttggccctgggcctgtgatgccagggtacaggggggctgggaagggcagtcttcattgggagccctgggctgggtaaagatggagcccggggcacagtcagctggacttcgttcctggctcccatgttggtttcagagcaccccccactcctgggcggctatcacccgctctcctctggatggaagtcaaagctccggcaccagaagccagagaataacaggagctaattatttcatcagatcaagtcatcagtgggtcgatttctgatgaattcccctggctcagacttctcgtggcctcatgccagtttctctccggatgctgaagaaatcaattaaagatgacacaagggattctgccttgttttttttcctttttcttggtaaaatattcaaagtggctgaaccgagagagcacccagtgaactcacgcagcaccagccgcctgccactccatccctgctgtggacaacacctctccttcccaccagttcctttccaggtctctctggctcctcctctccatcctgagtcttctccaggaccttggcaaaggctcgccagcccaggagacatctctggaaacagctaacgtcctgagcatttagaaacatcatttttagttctcaatttctctgccgatctgccaagaggaacgggtctgagtgactgatgccctcaccttcccaatgccacaaaccacagcggtgaacaaacacctgggacctcatccagacctgtttagaaagacccagatgggctgttttcctctgaggatctccaaatccaacaagaggaggagagagaagtttgggaacaatcaggcagctgaggtggtgggagaggaagaaggggccagaggcagaaggaggcactggtcagatggtaaatgtccatgaaaggcgggaagaaagcaaactgtgggtgtgcagatacgtcccacgggctggggccagagccccgcaacagacctagcggcctccccaggtggtccagagaacctgatcatttctctctcttccttctttcactttacaaatacgtatgaaggacctcctatgaggcacagtgttcagtgataggagaatcctgcctggattccaacagcctcctaactggtttccctgcttctacctcgtcccttccatcaagcagccagacagatcctgttaaaacaaaagcaagggcctgccttcctccactgaacggccttcaataacttccatcccacgcagagtaaaacgcaaaaaccctccaaaggggctacaagaacccacccaacctgctccatcacctctccgaccttattgccttcccctctctcccttgcacacctggttccagccacacggtctctgtactgttccttgcacatgctagcacagcccaccccagggcccttgaacttgctgctccctctgcctggagccttcattcaggttatcttcaccatcccttcttccccctcctcaggtctttgctcaaatttcaccttggcaggttaaaaccgaaatctctgccctccccagtagcacttaccacctctcacagctagctcctttatttctttgcggatgtcctccagcagaatatcagccccctgaaggtacaggtttttgtcatttttgttcagatctatatcctcaacaattaaaacaatgcttgcggcatagcaggcattcaaaatatttactggcttaacaaagaattatctcctgtctcctggtaacagcccctgttagtgctttgaggccacaagtgctcttatttcccacccccccttatatatggtttgactgcagggcagcgcatgtgagccaggtggagccaatcagcaattccagctctagcttcagcgattggtcctggggcagacatgtgacccaagtctggccaataagcgagagggagtcctggaggctggaggagactgtgctgggtgccaggaggcatgaatatggtgctgatggtggccgcccattggatggagcccgagagagaggatgctggtgacaatggggtggaccaagttgcatcttgtagccaggtacagactcaaaaaagtgccctttgctgcttaagagagtccgaattagggctgtcatttgcaacagggagcacccagaccaacacaggaaacaccctagaagaacaataatgaatgatagctaacatcaggggccctgcacaattctaagcacttttagtgtgtgacctcacgccacccttacaaccaccttgtgagttgggatgctccatttacagacaaggaagataaggcacggacaggttccagaacctgcccagtgtcgtgcagcatgggtgctgaatactgtccctttggtcctcccttcccatcttctctccacctccaaatccaacaagaggaggagagagggctgggcgcggcagctcacgtctgtaatcccagcactttgggaggccaaggcgggcggatcacgaggtcaggagatcgagaccatcctgggtaacacggtgaaaccccgtctctactaaaaaaaatacaaaaaaattagctgggcgtggtggcgggcgcctgtagtcccagctacttgggaggctgaggcaggagaatagcgtgaactcagaggtggagcctgcagtgagccgagatcgagccactgtactccagcctgggtgacagagcgacactgccttaaaaaaaaacaaaacaaaacaaaaaaaaaaaaacaggagagagaagtttggtaataattaggcagttgaggtggtgggagaggaagaaggggccagaggcagaaggcggcattggtcagacgggaaacactcatgagaggagggaagaaaggaaattgtgggtgtgcagatatgtcccacgggctggggccagagcccagcaacagacctgagggcctcctcaggtggtccagggagcctgatcatttctctcttccttcatttactttacaaatatttattaagggcctgctatatgtgaggcagtgttcagtgataggagaatcctgcccgattacaacagtaatccactcttccctgtcccctgggaggttcacttggatgtgccacctccaagtgacagacaaaacaagcaagccagcatggctatttgcacacagacattctgaccccagagcctactcttttgacacttatgctgacttggaaagcaacaagtgatacaagggactgaggttaagtgtgttgtataaacagcaagaggaaaggggaaactgctggcctgggagcagtcagggagggcttcctggaggagtacttagcataaactgagcagcctaacaggagcaaagttctgaagaatccaaaggatttggatggccagtgaagaggagggtggaggacaggatgcttcaggcaggagaaacagtttgggcaaagagcaggcagaggaaacagagagaggcccctggagggatgggaaagtgtggtcccaaacctcacaagcccagaagctgtctagacaggggatgacacacgcacatctgttaaactttacactcccctgtgtctccctttcttcctggctacaggctttctccagccttctctcctcctctttggggccgtcaaagaaaggacagaagctcctgtaacctatgggccacagcttctccctgtctcccctacctagcccaggccatcttgtggctctccttgcctgttcttggaattccaaatggaggcagagaaccaagccggctctcaagaacagggcaggagacaatagaagggtcattcagagggaggagggaaagatcaggtttcaagacaaaggctcaggatctggaaaggaaattagggcataaagattgtagggcaaaaatgcagggcttaggaacccagttacctgcctaactattgatgtaacaagacattcctgaaggctcgtgtgtgccaggcacagttcttggcactgtggataaagcagtgaaaagaaagctccctgccctcctggaagtgatactctaagtcaacataggaaaagctggagttgaaagattccagctacatgtgagaatgatcagaaaagaggactggaaataatggcaaaccaccggcaagctgtgagaacagagtggccatggattaaagttagagcacaaaggaaatttagaaacaatgtattcaagtcttaggaagctgagcaccaaaatgttttgtatgtcaagtgggtagatgtttgacaggccatataattcacaccctcaaatacctgagcatctgccacttgctttgtactgtttcatgatcagtagaaaaaaaaaaaaagaacagacaaaactctcgattctcagagagctgacaaacagcggacagaggtaagcaaacagcctgatacttacttgggggaaaatgccacagggaacacgctgagtaggaggagggtaggatctagagctagcctgcctgggtttggatctcagctccgtcacttactagaggttgggcaagtgtctgaacctcttgtcttctcagtgacttcatctggaaagtgaggacacctacaagcacttgcctacagagtggatggtttaacatgcacggagactttcaacagatctgtatgcagcaagtgcccaataaatgctggcttgtgttctctgctaggtttgggccacccaggattatctcctttctataacagctcccaattttcttgggagtctgaggccgggtgtggcggcttacacctgtaatcccagcactttgggaggccaaggcaggtggatcatttgaggtccagagtttgagatcagcttagccaacatggtgaaaccccatctctactaaaactacaaaaattaggctgggcacagtggctcacgcctgttatcccagcactttgggaggctgcggcaggtggatcatgaggtcagatcgagaccatcctggttaatgcggtgaaaccccatctctactaaaaataaaaaattagctgggtgtggtggcacatgcctgtagtcctagctacttggaaggctgaggcaggagaatggcgtgaacccaggaggcagagcttgcagtgagccgagattgcgctactgcactccagcctgggtgacagagcaagaccgtgtctcaaaaacaacaaaaattagccaggtgtggtgacatgtgcctgtaatctcagttactcgggaggccaaggcaggagaattgagctgagatcacgccactgcactccagcctaggcgacagagcaagactctgtctcaaaaaaaaaaaaaaaatattgggggatccttttctccccacccttggtccacaaagttcaaattaggctccagttctggagctacaatgctagatcgtgggatcctagacctgggccaatcagagcctccccaccccttgcctcagtgacgggccagagtaatccaggccctttggcctgactggtcaggaagaggcatccagtctttacaactggctaactcactccatgtggttccaatgtgaggaccagggaagacagcgacgccactttgtcttgagtggggtcgggaatgaagccaacacaccgaacacagcagtgctgtgaaatgcaccatacttgggacttaacagcactggacacctgggatccagcccagcctgaaagaggaagatttgggttgggttctttgtttcaggcccaataaattcctctttaactagtttctgttttctttgtaggtcagtttccccatacttttgactcttcaagatcagaagtgaaattcccttttttcaattaggtcattcctagttgctctctcacttgcaaccaaatgaacccaaattggggggcgggctggaggcagagggctgactcccgtggcttcctggccacctcgtgcctgtgtgaacagaggcctcagggcacggcctaccagcccacgctaggcctccttggcctgtgcccaactctccgccttactgagggccaactcgcccatccttctttgacaactgataagagaaggtagtgtggaaaagcggaaggaacgtgggtgtgggaatcacaaattctggacctgactcggccaccctggctgtgacttgggccttccctggccctctgtccctgaagcaggccctgctcggtcacccccacccccagtcccagcactgctctcttcagagcacttatcataacttgtgattcctctatttactctctggcctgagtttgtgtttgtgtgcgtgtttttttttttttttttgagatggagtctcctctgacatccaggctggagtacagtggcatgaccttggctcactgcaacctccacctcccaggttcaagtgattctcctgcctcagcctcctgagtagctgggattacaggcacccgccaccatgcctgcctcattttttttttgagacggagtttcactctgtcgcccaggctggagtgcagtagcgtgatctcagctcactgcatacctccacctcctgggttcaagtgattctcctgcctccgcctcctgagtagctggaactacaggtgcccaccaccacgcccgctaatttttttgtatttttagtagagacgggctttcactgtgttagccagaatggtctcaatttcctgaccttgtgatccacccgcctcggcttcccaaagtgctgggactacaggcgtgagccaccgcgcccggccacacctgcctaatttttgtattttttttttttttttttagtagagacagggtttcaccatgttggccaggctggtctcaaactcctgacctcaagtgatctgcccaccttggcctcccaatgtgctgggattacaggcgtgaaccgctgcacctggcctgggtttttattttgtagaggggcatccctccaccagaagctcgcatgggcaggggctgtctcttggttgcctgacgccacggccccagctcctggcagagccgaggtgctaattcttccagataggcagccgagatttcctgagcacctactatgttcccggccctattcttcagtgctgggaatcaggaaaaacaatccttcatggatcagacaccaaaataaattacacaacatatgaggcaacgtgtcccaaggagatcaagtcctaaggagggaggttggagtgctagggagtgagggggtgtaactttaaataggttgggtagcgaaggcctgagagatgacagttgggtggatccctgcaggaggggagggaacatgccttgtggatatttaggggaagagcatcctaggcacagggaacagaaagcgcaactgtcctgaggtaggaagatgcctgagggagggccggaaagggggcacgcatggcggcacggagctgagtgaagggggctggggggttctagcttgcgggtgatgtgatctggtgtagtttttttttttttttttttttttttgagacagagtcctgctctgtcgcccaggctggagtgcagcggcacgaacatagctcactgcaacctccatttcccaggctcaggcaatcctcccacctcagcctcccaagcagctgggactgcaggtgaggacaaccatgcccgattactttttaaatttttggtagagatgaggtcttgctatgttgcccaggctggtgttgaactcctggactcaaacaatcctctcacctcagcctcccaaagagctgggattacaagcatgagccaccatgcccagccctgatgtaagttttaacagaatccttctgactatgtgaggggaacagactgcagggcatgagggtaggcacagggaggccactgagatgactaggtgggagcaaagaaggggcaagaggtggacggtttctgaatattgttcagtgaatgaatgaataactgcacggtgggaagactggaattggctgaatgctccagttactaatactgtgtaacaatttaccgcaaaacttagtggtgaattaaaatctttcttttattctcagaggctcctgatcaggaacttgcgcaggacatggcaggaagggctggtctctgctttgtaacgtctgaggccactgctgagaaggctcagcagggccttggcttgtctggcagttgttgctggcagtcggttgggagcttgggaggggctgcggagtgggcacctccatgtggcctcagtgtggcttgggcttcctcacagcatggcggccttgcagtggggtctgatttcttacacaacagcgagggtcccagtgatccagggggagctggctcatcttttctgctgtcccatggtgttccttccaccagggctacgcacgtctggccagattcaaggggaggggacacagacccacatctcaacaaaggagcatcaaggtcccaccatggatgagcctgcagggtaccgtgtggccatcccgtaaaacagtcagtcctgctgggtcacagaggctggccaggcctggggcagccacgtgggcctcccctgcagtacatcctccctcctaggaagtgaaacccgatctgatccctggctgtcggggctgggcgtttgtgctcacgtccatttcaaagaatctgtgagcctcggaaagtcctgggtgggcactcttccttctcacatgacccaagggtgttaaagccacgatgtcaggtccagggggttctgagcagggcaggagggtgaactgaagggctcgtaccaggagctagagtcacaacaacctctcctccttattctagataacacatctgctcagttctatgtacgccagaaacattgatttcttcccattttttaaccactcccagcttatttttaagtagaaaggaagccacctaacaaacccagaaaaccccacagaagaataagacctcgtttggggaaaaaggccccaacctcccccagctcttcccttctgcagaggcaagaaattttccaactcagcctctgcccttgagccctgtgctcaaagccgcccaacaacatggaggttgccctggagtccaggagggaaggctgctgtccctgggagcccctctcatcaggcaggtattggcttgtcagtggcaggatggggcgggggcgggggcagtgatgatgaggctctgcaggcttcaaatgggggtgctgggccagggctccggggccaagcttggaaggatgctcatcatgcctggctgggcaggagacctggaaacatctcccaacctgccggaactccgcctgggataacacagcttttccacctgggccagaatcaactgctgctagagttttttacaggcagctccccaggaagtttctggcaagatggcagcttccagggcaggggctcctgatttgaggcaaatggtacagcctgatctgctccgaaagggatgacagggctgatcgttaacctctgtgctccatcccatatgccagcgtctcagaataaataaatgaatttttaaaagtctggtataagtagaatacccaaatctgggcctaaattcattcattcattccctttcttatttcaataaatttatttagaaagaaaagtctatcttggaggaaccagcacccattgccataaacctgggtctctcaaccttggcattactgccgcgtgggcaggatcattcttcgatgggggactgtgctgtgtatcacagggtgttcacaggcctctgtccatgagatgcaagtagcacctaccccagttgtgacaatcaaaaatatctccagacactgccaaatgtccccctagggggcaaaactgcccctaggtgagaacccctgccatacttagatggcaacagtataaaggcaatgacattgtggttacattcttgcttgccaaggcctctgcgcttccccttacattgggagtaggtctccttgaagaccataaaggaggagttcacgcgattccctccttgatgacccagaggcttggaggagagcagaaaaggaaaaggggaaaaaggaaaagttaaaggtttttacgttggaaatggcatttccaatgtagtccaggccctaccccgtctcttatcctgaatctaggccacttcactcactcaggtctcctgcccgaccctcctcctgccatgacctgcttatgatgagatcaacgccacttacgccctgtgcgtggacggctaagatgaagactacaccttgatccagtcaatgggacctggttggtggaggccaccggtctggcacaagacttggcaatgcaagaagtctggatgttgtctggtgacctttggagagagatatgtttgcagtggcctttgtctaaagcagggacaaatatgcaaatgcatccaagggtcgggcaggagacctgagtgagtaaagtggcctagatttaggatagagatggggtggcgcctggactacaccggaaacaccatttccaaagtaaaaactttcaacctattttaagcactgagcgggctccataaagccccgctggagcttggcctgggagctatgtgcgactcttccaagctatccaatctttcctgagcacctactatgtgccacatgctaagaaacagcagtggccacaaggcaggccaggcctctgtcctcatggagctgtgataccttggtggaggagaaaatgaatgaatgaagattgtcttaagagctttggaggaagctgtcaggtgataggatggacagtaaattgggaaaggcctctctggcatgaggaggtggcataaggaaatggcatctgagctgagagcagaggcgggcgagaagccagttgtgggcaaaatgctttctatgaacggaggaagtaagtgcaaaggccctggggtgggaatgtgcacaatgaaaccaacatggtgcagccgagcacggcagtgtggcccacaggaggctggacacccctttgccccagcccatgccttctgggcaggccacacccgctgtcctttctggctgtttagaggaagtagaaatcagatacagaaattcccacctctgttctttgttcctttgtctcagctgtggacaaaagcttccctggcagggagttacaaagttatttctgcaaaaggcctttggccaaaagcaataaagtccgacttgaacagagtcattattcacgcctaactgtgggctggttctcagtgtagactgccacagtggggactgacaattccacctttttaaccccctcctccttttcagccccacattttcttagccctgcttacccccacagaacatgtatttatgtttccagagattgtcgtttccttccagaagaatataaaaggaataaaaggtattttgacggcttggtattaataatccaattacttctttccttttcacccaatccacaggcgagcgtgccgtcctcagccagcttgcccctgctattagcagatgagctgttcattagttcaccttggaaacagcccgacacttacaattattttagaagctgggggaaggagtcagaatcaacttttaccaaatcacctgctacatttggagatgcgagtggagtgcctttggaacgacaggtcggcttcccaatgtggcttgctgtgcaatctaattagcagccggaaatagaccggcaagtgggaggaaagcccgggtcagaggctctgcgagctgagattagtctggatcagtttttcctactagcagcctcccctgctgcggggactcactgggtgtcaccaggtgttggggtggaaggcagtgtcactggtgaggcggggtctgggaggagggagtgcaggcattgagcccaggtccctcattaccgcgcatgctctcctttcaggagccagaagcaaactgcccctatcttctggagggggatattgaggcatggcaggggttctaggagttgactttgccccgtaaagtggagagaagcttccagacccccagcagcacctgagctatggggccctggagctggagaagctgccacacaggtttgggcattctacttatactggactttcaaagtccattcactcgttttaaaatgttcattgctctgccaggggtggagtcacctatgcaggggcggtgcagagatttctaacaatttttgtccatctggtccccttcttttgacagcaccccagcttccttttgaggactccctcccctctgccaagatgcccccatcctctctgccaaggggtgatcatgtgaccaaggtcaatcagactttcttaccatgtccccaactgtcaaataaagtgtcaagggcagaaagaaaaagcaggggtgcatttgtcgcattgggatggaaactctccttcaggaggctgctagtaactcctgcgccaaggtccccagaatttcctcagttcctgacctgtcctttcctgagccccccagtaaatcctgttccagcttgaggtagtaagtgttgggctctgctacttgcagtctgtgatgaatgggtactttggtggactccaaaaagccacactgcctggtattcaaacccttgtgtgggccccacctcatgaaaccgggctggctttgggacctgttttgaccaagagaaggtggcagaagtgatgctgtgccggttttgcggttaagccttaagagaccgtggcagctttcatttttgcactcttagaagtcaggctaccctgaacctgccatactgcgaggaagcccaagtagccatagggcagagcccacatggagaataactgagctcccatctggtgaccagcaagagctgccagccatttgaatggggttgttttagacctgccagctgatatcacatgaagctgaagaaccacctggtcaaaccacagaatcgtccaaaataaaatgttgttaccttaaaccactgagtttggagtggtttgttatacagcagaaacacaacccaagaatcctcagtgacactgatcagagcccattcccccaacagaaatgtcacaaatgactatgaggttaagactttcagcctcttcggctaatgaacacttggaggagaacatcattcattcattcctttagtcattcattcaaacagccagtaagcctagcacagatggtacaaagatgaacaagcttcaggacctcctgttctagtgagggcatcacacacagtgcctcagtttccttactgataaagtgaagatgatattagtccctgcttcaaaggcttgctgtgatgatgaaatgctgggcaaaaagtaatcaatagatattagacattattattactacacacttgcaatgcacaatgtaagtgtccagggacacttgcaatgtccctggaagtgtagccattgggtacaaagtgtcacaacgggagacaaactcaaatgcctacgtgggccaggcagataatgtaaacgggtgaagtggacgcataagaaaactccacaccccacttcctctccagctctcatctggccacttttggtagagatggaacagagaaatattgctccacaatgagaaaaacagaagggaaagtgcaatgaaaagccaaatgaattggttcacaatgtcaggctataggggatggtggggaccacatctccccatttttcaggagaagctgaaaatccagatttttaaaatgtgaaatctcgtagttgttacaaatctgacagctttttagaaggttcaaacaaaacatttctgcgagctgaacagagcccctggttaggtggcctgtgatgtcctattctaccagcatggcagagcaaggagagacttcgttgtgtctctttcctcctttgtaaaacggggttggaagatccccacatcgctgagttattccacattcacaggagcgcgcacttaaaccaccactagcctgtacaaagtgctcggtaaatgtgagctttcaggagggtaggttggggagtggaggttaaagaggctgctctcctgggctgtgaccgctgttctttcaggaagggacaatttagggaagggagttgtcttttcaagggcacatgcagaaatatttaacccaagagccctcattagaatgtcacaccactgacctggaagactagcttggccccagagtcatcagaagtggagggttccaccagcccttctgcaaggccgtgaggtccctgccgtggcataaaggggacgatccttcctctgcaagcaatgctagcacaaaaccccagctctggcactggggagcaagtgagtgtgtatgaaaccaatcctcccagccacctgcttagctttttgcaaatgactaacaggttttgacatccttgccctgagcagtcaccttcgagcaaacatgctagccagatgtgcctgtagctctccaagcctctttcttttcttgcttccttcattcaaaaaaaaatttactgagtatccaaagagtgccaccctggttctcagtgctggggatacagcgatgaacaagacagacaatgtccctacaagcacagagcttgctttttagtgaggagagagaagacaaaggacaaataagcaaaccaggctaattccagagagtgataagtgttataaaacataaaacaggttgtccttccagcattctagggaggtgacatttcagctgagatccgaagcataggaaggagccaggtcctttcccagtgtttgatttagaggtgagtgcaaaacccaactccggaccaatgaaacagaaagcaaagtctgctagggtgggagtgttctggcaaggattttactctctgattaaaagagagacagcaaggagtcctgtcctatagtcccactttgtagggtgatgcgacgtctggagctgtggcagccatattgagactatgaggcaacaaggccaaagacatgatgaggacagaagaagaggcttgaaagatcctgggaccttggatgacactgttgtactgaaaaaccagcgcctggactcccctgctttggacttggtgttatgtgagaattaaatgtttctattgcataagccactgtcagtcagaaatgtgattcctcataatgaaaccatttcaattcacattaaaatgatcaggactctaagctactaagaattatagtaggctttcctggtctctgaaatatccagataagtggcctgcaatcagaagtctatggatagtatctgtctcgagagcagaccagaaatgtggctttcagatggtctgattttcaccaagcaggaacatctccaaggcttctgtgagctaacagttttttcaatctcttttcaaaaagttccaggccaggcagggtggctcacgcctgtaatcccagcacttttggagggtcacttgagcccaggagtttgagaccagcttgggcaacatagcaagatctcatctctaccaaaaaaaaaaaaaaaaaattagctgggtatggtggcctgtgcctatagtcccacctacttgggaggctgaggtgggagaatcacttgagcttgggaggttgaggtggtagtgaactgagactgtgccactgcactccagcctggatgacagtgcaagaccctgtctcaaaaacaaaaaagctcctcttctctggctactggggtgggtcaagtcacccgctggggtcctgaccatgagccaataagaaaagctattggccacattcttcccctaacacatctggcttccacatggccaaacacatctttggtactatttgtggtccctggggatggccctgtccaccaacttacacacacaagacctggccataacaactctgagtttgggatagaatttatctaagattcaagctgggcccaggtgtgcagagcagtgggccaggccttctgtaagatgacgctccatggcagaggccagggccactgggcaacgtgtgctttggaatcacattaagagaacgtggggaattcaaaacattctggttacagagaattccaagaagccctggcctgggctggaggagaagctctgaaggccatgccaacagctgttccacccagaaggcatcgtgctgcctacaaggcccgagatcccacatgaccttaagcaatttcccaagggcatctgtggcagagcaatgaatatttagctctgtctgttaatcactgagaaaccaggcgatgaagaaggggaggctcagcccgagccttcaggaacttcttggaaatgtcagagaggtgagcatgtgggatatgctaaaaatattcatcaaatagattcatgacaggcactagggggaggctggggggagaaaaccacactagaaaacaaaacacattctctctggataattgtgtccagtcccacagcttaaaataacatcaatatgccgataactcccaaacttaggttgccagccccgaccggctgcagacatccacgttcaccacccactgagctttcagacatccaggtggggttcatctcaaacccaacatttccacgtcggaattccagatcactcctcctccccaaaaccttctctcctatcttccctatttagcaatcaccacgcaccaggctgcctagtcacctttgactccttggcaggatacatcatgaatatttgggctgaatcatttttcactgtggggtcatcccgtacattgcaggttaagcagcatccctggcctctaccctctagatgccagtagcaacccttccccagttgggacaacctatactgtctccggatagtgttaaaatgttttctgggtgtcaaaatcaccctcggttgagaatcaaagccctttccctcactctgtaatccaatccactaggaagtcctgtgggccctacctccaaaatacatctccaatccccatttcactccatctccattgataccaccacggtccaagccactctcgggccctctctgttgcctaacagtcccggtgataccacttccatctgcacagcacgcctctcacaggagccagcaggatcttcttgaaacacaaatcatatcattctctgacttaaaaccctccaatggttctccattttattttttaatttatttttgagatggagtcttgctctgtcactcaggctagagtgcaatggcacaatctcagctcactgcaacctccacctcctgggttcaaacgattctcctgctgcagcctcccgagtaactgggattacaggtgtgcgccaccgtgcctggctaatttttgtatttttagtagagatggggtttcaccatgttggccaggctagtcttgaactcctgacctcaggtgatccacccgccttggcctcccaaagtgttgcgattacaggcataagccaccgcgtccagacagttatccattttatttaaaataaagtctaaaatttcttagcatggcctgtatttctcatctctgacgtgccctcccccacttactcctgaccctctaccctagttgactttttttttttttttttttgagacagagtctgactctgttgcccaggctggaatgcagaagtgtgatcccggctcacagcaacccctgcctcccgggttcaagtgattctcctgtctcagcctcccaaatagctgggactacaggcacgtgccaccacacctggctaatgtttgtatttttagcagagatgaggtttcaccgtgttggtcaggctggtcttgaactcctgacctccagtgatctaactgcctcagcctcccaaagtgctgagatttcaggcgtgagccaccacgcctggcctaccccacttgacttctatttgtgtttggggcaggtgtcttggacaggcccctcccaccgcctctgggcctttgcactagctgttccttctacctggcatgctcttcccccagatctttccaaggcggactccttcctaaaatctaggtcacagttcaaaggtcacatcctcacagaggcctccctgacagcctgcctaaagttgcctcccaccccatcacatcatgcagtcatttttcttttaaatttttttttgagactgagtctcactttgttgcccaggctggagtgcagtagtgcgatctcagctcactgcaacctccgactcctgggttcaagcgattctggtgcctcagcctcctgtgtagctggaattacaggcaagcaccatcacacctggctaatttttgtatttttagtagagagagggttttgccatgttggccaggctggtctcaaactcctgacctcaagggatcctcccacctcggcctctcaaagtgctgggattataggcatgagccagcacgccaggcctagagcattttccccgccttctgacagcccctgcattaggcaggaagacaaagaggcccacgctccagagctctcttcgccaaaccctcctgctgatatagaatatacacatgacatattggtcatgccccccagcatccaggaccctccctagaagtttgattcaacaggatctggtctttgcctttttaaacaaatacagccagatgattctcatggtgggaggttagacaaacactgcccctggccccccgaaagcacaggatcaaggccaggccccatccttcagacagtaaggcagaaaagtcaggcctttgatgcctcctggccctggtggaagggagaggcattgcccaggcagcgtgtttccccagtctccaccttggccaaaatgaagatgggtccatctggccagcattgctcacattagtggcccatcatcgcaggcactggccatctgcctctccagcaaccgggcttccctttcactggggactccccgtgctgttttattccaggctttggggtctcagcagtcagcctccatccagctccagggagaggcctgtgagcctggcttaagccaattgttggcaactcatttccttagccagtgactggtttggacaaaaaacagtccaatcagagggaaccatggggctcaggtgtgcattgccagatcagaggcttgttctttccttttgggcttaaaccagaggggatgagacccctctgctccatgacatctgtcctgacacctaagttatggtaacagtcaatgcctactgaaggctcacctgggtcagacgccctgctaagcacttgacattgatcatctcatttcatgcttaccacaagcaggagacaggtgctatgatcatcatcatttgttggatgtgaacatcaaggcacagaaaggttaagtagcatgccccagatcccactgctgggcagggagccaggcagtctggctctcctagccacggtgcccacagctgccagggactgcccgccccagagctggagagacatcagcctcatggaaggcagaggagcggtggataggaatggattctcattacaaaatctgagctgtgggtccagctgtgtctgaagctagagttagtcaccttaagacttttggttatgaaaaccagtaagtccacttcttttctccttaagctggcttgagtttttttcttctctttttccgttgcttgcaagagaaaggaacctgattactttacagttcttctaggcaagtacccctaactgatactccatttgcaacttgcacacagcagctgctcagtaaacaccagcagatacggatggactgctctcccttccggtccattcactgctggatctgtaccctgacacccaactgtggccagcccagcgcttcttcccctttaggctccaagtgaggcctcgttccctagcaaccaccccaattaggcaaccatgccatttatcgggatgccaattaattataacgatcttaatgccctcccaattagacagtgccttcaatccggctgggccagggctgtctgtagatctccaccaaggcccattccaaggaggcccagagaaagcaggtttcagggagggccccctcacctgcagatcagcattgagagaggcccccatcttccacatccgcccaggcctgacacagagcaccctggcaccacccccagggccaggccatcgagactccatcaccaaccacaggaaggtctcacctctaggagagcttttgctctctggccactgtgctctgagtgggctgaaatcttcaccatggttcacctggcttttccatcagctgcatttgatgtttccctttgcattttgactgggggaggggacagtgtgtctgctcataagcagaagaaaaagcaccaggcagacacatgttttccttggggcaaaaaacctcaaatacaaacccggactctctgtcggaacagtgggggtttatggaaagttaagggccttttactttgcaaagtttgactgtctgaaggtgttttcttcccctgcatatgtgtttcttctacatctgggacaaaggccaaggtcatggaggagagtccagtggttccaagtggaccccggagcttgagggcctcttgaatcccagctctacctgtgaccagctgtaggcaagtcacaatcctctctgtgcctgtttcctcatctttaatatggcaacaatggcagtacttacttaacagggtatttgtgtggatttaatgagtaaggtataagggcttagatcaatgcctcagatcaggcccatacaaaactacttaagtgttaccaattatcttaagtctggactaaaccttttcttttaactacaagctggtcagaaatgctgatatttttctgtaggacagggcttctggactccttctgcaggactaaagtctaaggtcagataatggccaaagcttgacagagttgggtgatattctgcctggttaacccagctgccctcttgaggcaggtccaagcagataaactaaccagtgccagaaaaagtgagaaggaaatgttatctcccaaatcaggtccaaatcaggtgtgaaactgcatatcaactgggttctttggacagcagctgaactgggggacatgcacgtgcatgcacacacactgctatgctgtcctcctccaagaccagacttttacagtcaactcatcactctactctcaagtttgaaaatttaacatgttattagggtttcagaaaaagccataaattcaaataaaaaacccaagaagtacacacaaagcccaaaccccaaacccacattgaccctcagctgcagcagtgatgccaacatcacggcctttatgtatataaatttagctggggaaggaagaggccttcatgtacaaaggtccaacatgccatctgccaagcccaccaccttcgcctttcaagctgcttattagaacgctaaattacacatccgacaggctgtctggatgagttttctcttctctatgatgtgggagagacgaagctggggagaacatctcttacagggaaggggcccccttcgttctgtcctccctaccccgttcctatacttaacgattggctctaatttaattagaaccctctggtggttctgtaatgggaggcagaggctgtcaagaaatcaccttcactattcactacaagctgaaatttggagagcgcgcagatccgggggtgtcctccagagaaagcccgtctctcctgctccctgtctccccctgagaacctgctccagcgcagcctccccttctctgccccaaaagtgggggtggacccggtgggaaacaggcaggggacagatggaggggcgagagggcgggtgtcccaacacgcacagatgagcaaatacccagattgaaacgtaagctgaatgtaattacttggttaattaaatattgacttttaactcaaaaagtgattaaaacaagctgcaggaagactttccagaaaggggggcagggaatgaatcaaagctttcaagggggaggaggaggaggagagggtcgtcacaggcaggtctggcttgctcttcctactgtgtgctgggcctactgcgtgcaggtgggggagttgcggaccgaggccagtgtgcaaactaggattgcaggcttccctttccatcttccaccccgagacggcatctctctaccctgctgccctcccagtgaaccggcagcttctggcgcgcaggagccagatcctgttcagccgcgtttccctggaacagaacgcggtgcccggcacgagggggtgctccagaaatgcttgtagaacgaatgaacgaactactataaggaatgtttggaaaagtgcactcctagaattcaccgctagacttttgaaaccccgaggagccggggaggggagcatccctccgccaggcgatggaaactcgttctgccctggcctgggaggaagtctgccttttcgatcctgtttgtcctttcggtgtctgcgagtttccaaccactctgaagatccggcccactgcttccccgagtcctgcccggacaagccccacgtgggctggcatctaccggtcccttgggtctaaaccctaagggtcaacaaggccatgcccctgcggatggccggcccaggcgcgctcccctacccggggccgcctgtgctcggtgtgccgtgtccgcgggtcaggggcgcggcgggaagtcctcgcccgcccgccagccagcggggtcaaacaggtcatccctctgcggacggccggcgccggagcctccctcccgcccgcccggacccacctccgcaagcagcgctggggctggagccgggcggtccggaccagccccggctcacctgggcggcgctcgcggccgggctcacgccggggaaggctccggccgccgcgagcccccgcccgagccccgcgtcccccagccacccacctgccccccacgccccactcaccagcgcgcacggccccggcaacctcacccggagcggggcgccgccgccgcctctgccgcagcccggccgggccgctgggcgcaggggactccgcgccgccgctgccgctgccgccgccgccgccgccgctgccgctgctgcatcccccggcgagcgctgctgctcctcctcctgcctcctccccgccccccaacgccgccgccaccgcccccggccccctccccgcgcgccgccccagccaaagtccggctccgcaccccgcccggaccgctcttaaatcgccccagcccggccggccacgctgccccagccagccccttggcacggcgctaccgccccccgctcgcctgcccgccggcctccacgcaggggaggcgggcgcgctccggggcggggagcgtcgggccgggagccgcggacggctggggcccggggcgcggggggcccagccgcggtgccctcctcgagccctccgcgcgctagcgcttttacctccggcctgggggacgcgcggcccgcgacccggccctgcctgtccccggcgcacggccccggccccggccccgaagtccagctccggacggggcagtgaacgcagagctggggtcccggcggctctcgacctcccgatgcctccggactcggctggccgcgctcccggcgccgagcgcgcaccctcgccgggacacacagacgcacactcactcgacacactctcgctcctgctcgccctcggcggagagttgaaacagatgtgggattcgcccaggagctggaaacgagggagggaagcgagccagagccttgtgtgcacgtgtgtgtgcgtaacacacaaaccagggggcatcgctaataaatcaaatatcgtgataaattcaggagggccatcgatcaggtccacttggctggaaacgacgtgaatctgcctcttttccgctttcttcttctcctctctcggagctggagggagccaaatgttccgcggggagtgcgacagccccggccgggcgctcccctcgtaatgacacgttaataaatgttttcttttatctgctttcacaggactcgccccggtctgcaaacactcgactgcctttgccgaaagcctcgcgctcgcctccagccacacacatttgccattggagaggccggcgccggccgcgacccgcagctcaatcgcagggcaaaccgagctgcctgtgcgcgcccgagaactccccgagaaattaacttcggctcaagtgaaaatagcagctgttgtccagaaatggcccgggagtagcatagaaaggagaaaccggcttcctccgaaaggggaggaattggactcaagggggtgctgtctaccgtggtttccgctgtccctcgcgccacagaagaggccggagggggaccggcctgacgcgggtgggcaaagagcgggcagagaactcaccagcagctgcagaaaacacagccgagttgctagctaaggggaaacagacgccgctgtgggaaagcacttgtaaacagcagtaacttattaaatcttgtgacaatctcacacagtaagttactatgcccgttttaccatggaaaccaagagaggtttagtaactgtccgaagatcacacagttataagtggtggatcctgtgaagccaagaagccttagctcccggctcatgctcttaaatcctaggatgtttttacttttcaacctagcatctcctttctctgatatgatcctccatggtagagttgtcagacttaacaaataaatatagacatccacggggaggaagttagtactaaaaaatcattcatttttaaatctgaaattcaaatcggatctcctgactgggtttggagctctaggctcctccccataacctctgttagccacgccaatcaagttagagcctaaataaatcagaaaaaccttgcacttgcttttccaagtcaggtgctggccctacctttggcatcactgataaggctgaacagctcccaccttctttgccctgggacagaatgtcaggcttcaccatcatagaccgaaaaataatggagacccctctccttccgcctcatctctgcagaaggacatatatatcatttagaattttctagtagtggcattagaaagtaaaaagaaacaggtgagggccgggcacagtggctcacgcctgtaatcccagcagtatggaaggccgaggtgggcggatcacttgagttcaggagttccagaccagcatgggcaacatggtgaaactccatctttacaagaaatacaaaaattaggctgggcatagtggcatgtgcctgtggtcccagctactcgggaggctcatgtgggaggatcactttgagcctgggaggtgaaggctgcagtgagccatgattgttccactgtactccagcctgggtgacagtcagaccctgtctgaaaaaagcaggtgaaattaattttaatattaataatatagtttacttaacctagtatatccaaaatcgatctcttcaacatgtaatcaatataaaattaatgagatatttttacattattttttcttactaagttttgtaatctggtgtacattctaaacttacagcacatctcaattgggaccagccacatgtggctcaggggtcccatgctggacagtgcaactctggcaggttctgcggtcaatggctgtttccaccgggtcatttcatgtaatcctcctgacaatctttcaagcaaactgatgctcagagagataaagggtcttgcctatagtcaaaaacttggccagtgggatttcaacccttttgatgctgtccctggtttggggacatgtaccccactgcagaagcaattttcttactgaatcctcagggccccttggtggtgcttctggggcctggggtggtggagggaggcccaggaatgggatctgcctccctcctactttttatgttgggttctggagaatatttcaggggtggggaaatttccacggcaaaaaaagtctaaaaaaaaccccactgcattaccacactgtgcccttaggtcctcgagttcctgaacatggctctcccatacccataaggatcctgcccacaatgtttcactccatccttctctgctcgtcaggtaaccccagtcagagaggggatgcttacaatcccttcttctggggctgtgggcctggcggacacgtggcatttgcttatctttttggatatgttgtttccattgttgctggacattaccaaacatggtaacgtctatgttggccccttatccttccttaagtagacggggacagatcttgtgtgtgcatgcatgtgtacctgtgtgtccgagcatgtatgtgtgtgttcattgtaggcaggtgctatgggtcatgcgttttagtctggacttactggctcagacacccatgaggtcagagggtctgcaaagctcctctggccgtgtttcttccccataattcccagcaaactccctggtcctctgggttcaaggcctcagcctgttttccaggtccttccaggccggtggggaccgcaggccccgttacggagcttggagctcagtgtctgcctgggatacatgaggggccccgagggctcacatgtcccccagcctgggaagtcactcagccgggcctcggtggggctcagcagaatcctgggcacccccacggcctcctgatactccagcccctgccgcctccacccacacggagacagcttttctcctcccacatccctcatcccccatgacatctcttggtatgatcctgaccatcctagctggacaatcaagcttttcaagctcctcatgccgccccattctccccagcattgttgatttaacctcagggggacctttctcttgacgcctccatgcctcgtttcttccctctgcagattctttggcagcccttttgtgcagaacagccatccggttctatctcccttgcaaggccggagttgctgttttattcccttgactcatatataacaataaaaaaaatcattcttgctatgtgtttctttatctccatcaagtggttgaaactcaatctgattgtccgagcacttctggctggatttgggttggagtcgatgggattttatgagggttgtaaaagtcaagcttttaacatgtctcaaacaaattggcgtgtaaaggagaaacgttagaagaaggaacatggctgcagacgggaggcttgggaatgctagccgtagtactggggcacaggtggctttaataatgcacacaagtttggctgtaagttgcttctacaagagcagaagaggctgcagaaccactctcaggaggttgagatcaaacttctcggctcctgagtgcacacagttttgcatggcttttaaaatacagattccaggatcatccataacaatataaacctgtggttaattctgctgaattttcatttagacccaagctgtgttgtcagtagaaatgcaattgcgttagagaaaaactgtttatatttcttgagatactgtgataatgaaaaacagtaccataaacccccattaagtaagaagaacattaattgtatttcatgctgcctccctgggccagcacgctgacacagacatgctttacttcagcaaaacacggctaatctttgcagcacggtacccattttcccctttaattatacataattgtatagtctaatttattctaacgcctgacgccgaaaagtgcacatttatgaatcaagggttagtttgggagggaggagaattataaacgggtataattgcagtctcctgggggctgcttatgagtgatttcaaagaatgatgatgtttattctgaattcttaccagtgaaagacagtagggctgcctccagttaagatactgttctaagaacgcagataacaggacaatttgtctagttgcttaccacactagtggttttcctttggataagcaggcaagaaagattaaagatgtgggttccacatattttgtgatgtgatgaaatccaggcacacagacagcatcagcaaatgtgcaattgaatattaaaatgagtaatgtggccccaggcagcacagctgcagatctctgtggacaagggagagtgcttggaactctgttggatgatagttttctcagggggaaaagcaggatccatttgaccattagtgcaattcactttagggctctctctggaacagtgcatctagttttgcaatcgtatttcagaaaaatcacctttaagctttgatcataattaattaatcaattatgatgaatgttgatggtgatttagtaaaagtggaatgatgacttagggcccccccagggctgaggtttctaacgaacctaggctctgcctccactgtctggcccctccttggctgatcttcccgggcctcagtttcatcttaagaatgaggataatatcgaggacattgctggctgtcatgtggattaagtgagattgataaaggtaaaacgcacacacaacgcctggctggaaggtacacaatgagtgttcactaaatcagaattggaaacatgctgtcttgtgctcctgagagagatactccttcatggtctgcaaagccagactttgaaatccagggcagttgaggcaatgatgccaaaggaaaccagatcacgccactcttcagcctaaaatctcctcctcttagatggagacgcgatcctgctcctgcctggcactccaacatctttcgctgctgtcttgcttccatttttattatgacaatttcacatggaaaagttgaaagaatagtacagtggacacacttatactctccacctagaatcaacagttgctaatattttgccatgtgtgctttataagttgcagaaacatttgagaggtggttgcagacatgatgacacattacccctcaggacttgggcaggcatctcctaagaatcagttgttttcccaggtgacctccctattattatcacaccaaaggaaaggaacagtaattccgtaatcactcccttgctcacagagacacaaaggtatctttcactttgttcctcaagccttttcctgcctcagggcctttgcactttctgtggcctctccctggcatctctctccccagattgtgctccaaaaactctttctcattacttgggtttcagcataatgtcaccccttgggagagtttgtccctgtctgtttcacctaaaaatgcttcccaatcactctatcctccctccccattttagcgtcttcctatgacataccactatctgaaattctggttttattttctgtctgtgactgcggtctatgtccccctccccactccccacccacactacctgcaggagagcaggggccgtggccatttgttcactgttgtagctgcagtgcccagaacactgtcttgcatggagtagacactcgacagatatttgttaaatgaaggaatgaatatcccatatgtgatgttttcaaacagaagaggtggtaaaatggagggactggaccctagtttttagagataaatccacacagcttcaatcccagtgctaccacgcaccaactgtgtgttactgtgggcctgtgttccttaaactcacctgccaaatagggacaatgacaatcatctctccaccttctaggactgttgcgagttattaatgagcttatataccaagagcgtagaacagaatctggcatctaacgccaacctttcataagcacttacgattaatgttgaataggctggccagaggcccatgattttaagcaccactggctgttcacaggctcacacagaaactgtctccaagcacaatgcccctgggagaacttcttggaagtgctgatgctgccctgtgtgagaccagctaggtcaacatttgcctggaaaaagctctggttgtttacagcaggcatctgggctgatgagtcagggcctgtggttagacattttgattctcacccctgagaccagcccttggaagctcacacaggagccgaggcagggaacctggagagaagaggacaaacagagacttccctctgctaaatgagagtgaatccgctggcaaaggtctgactctgcggattccctcccactccactctggtaggtagactctgttgtgaattttaccttattactggcctgtactttttttttctttttggcaaggtcttgctctgttgcccgggctggagtgtagtggtgcaatcatggctcactgcagcctcgaccttctgggctcagatgatcctctcacgtcagcctcctgagtttctgggaccacaggtgcatgccaccacgcctggctatttttttgatttttttgtagagatgaggtctcactacgttgcccaggctggtctcgaactcctgggctcaagcagtccttctgccttggcctcccaaagtactgggattataggcatgagccaccatacccagcagcctgtacatttttaaaaagagaatatttggtactggatgtccatatgcaggggcatgtaggtaaagatgcttttcagctaaagctgcaataaaaaaaaaatgagttaggactgggcgtggtggctcacgcctataatcccagcactttgggaggccgaggtgggcagattgtctggggtcaggagttcaagaccagcttggccaacatggccaacatgatgaaaccccatctctactaaaaatacaaaattagctgggtgtggtggcacatgcctgtggtcccaggtactcgggaagctgaggcacgagaattgcttgaacccgggagtcagaggttgcagtgagctgagatcgcaccactacactccagttaggaaactaacagaagtcttggaaattttgacgataaaaattgcatttaactggaaataaataaggtagtctacccaggaaagtgtgtatgtaatataggtaatgggatgaccggctttaatgcagttgactcagctagcatttctactgtactgggtggaacggtgtccccccgccccaattcatgccaatccagaaactcagaatgtgaccttatgtggaattggggaccttgcagctgcagatagttaagatgagggtgtaatacttagattagggtggaccctaatccaatgattggtatccttctaagaagagaaagtgggggccaggcatggtcgctcatgcctgtaaacccaacacttgggagaccaagatgggtggatcacttgaggtcaggagtttgagaccagcctggccaacatggtgaaatcccacctctattaaaaatataaaaagtagctgggcttggtggtgtgcacctgtaatcccagctactagggaggctgaggcaggagaatcacttgaatccaggaggcagagattgcagtgagccaagattgcgccattgcactccagcttgggtgacagaacgggactctctcacaaaaaaaaaaaaaaaaaaaaaagagacagagagagtggggacgtagagatacagggaagaagttcatgtgaaggaggagacagagatcagagtgatgcttctggcagccaccagcagctggaaagaccctccctggagcctttggaggagtgtggccctgctggcaccttgattttggacttctggcctccggaactatgagagagtcaattactgctgttctgagtcacccagttcatggttattgttataactgctctaggaaatggatatgcccatcaatgagttggggcggcggggggggcggggggtcactcctcttctcccagggtgaatgagtgatggtgacagtggaaagagatgtccccacggtgacaccagagcaggaatctcagcccaggccccaaatcagagattctgatttaatggttcagtgatagatccaggcctgggtatttttttttttaaaaacaagtttattgaggtataatttgcataccataaaattcacccatcttaagtgtaccattgaatgatttttaaatgtcccaagttgtgcaaccattactgtcatctggttttggaacattttcagcatcccagttccatcccttacgggcatgggtggttttcaaagctgcctaggtggctccagcctgcgccagggctgagaactcccgctccctggggagtcctgggggaaaaggagagtggtataaggtttccccagaggtgctcaggactagttgaccctgaaataaatgtgtaggtaacttcaaaacatgccagtaggcatccacagaagcagttttggttgcggtggtggggagagggtgggaggccggctgccgaggtgcatgaaagcccatctgggctgtggacagtgtctggggagggggtgacgagggaggtgctggtcccatttccacctggctggagagagcactgtgtccactccccagtgcatacatcctatctgccctggaagttagggtggggggatgggagatgggaactggggttgctagcagggagtcagtgggtgtgaggaggcccagcctggcccctgcatggcccagagtcaggtatgtgaggctcactgttccagaggagtgaagcaccacccccaagaacacatagtaaggctaacacaggggagaagaggacccagggctttgactcttttatttatttatttatttttgagatggagtcttgctctgtcgcccagggtggagtgcaggggtgtgatctcggctccctgcaacctccgacttcctggttcaagcaattctgcctcagcctcccaagtagctgggattacaggcacacgccaccacgcccagctaatttttgtatttttagtagagatggggtttcgccatgttggccaggctggtctcaaactcctgacctcaagtgatctgcccacctcggcctcccaaagtactggggttacaggcgtgagccaccgcccccggcctctactcttgttccaccttggcgcagctccctgagccctgtacaaccctggacagaggctggggccagcttggtcctgatcagcacccagggccggtctctgctgggctcctgctggagcatttccttgcctgccttccagcaagaccttgccttgccacgtgagtctgacctgagcagtgtcttctgtccgtcacagcctggtcctctgccaggacttgatggaatcgctgcccacttggcacccaggtctgtcctcaccctgcgatggctcttgggtgactcatcaatttgtgcttatatccggtcgtctgtggctctggcaggtcctggtacccacaagggctgggctgccaaccaggcttgcagcagaggcctctggggtgagcctggcttatcctagtcggttccccttcacctcagagcgagtgatttatgagtatcacagctactgctgattgaatattcactgcacatatatgggacgtcagctctgagtagcagatccttgtcggtaaacggactcccagatctcccccagccttggatcctttcaggaccactgcgtggatcacatgtgagtgtgaatgtagaacagaaggataaggcattttcttcttcattaatcatattccatgctagcaaccttccagaagtttcccctgtggctaaggaatatgtaacaggtactggctgtttgcagctgcattcactcagggtcataaggcatcacacgcctggctattggagttctcagccggtggtgtctgtttaggcgattagtgaattaagggcttgtttctttgacttcaacaagggaccacatcccagtgggcaactaacagacactatttgggatggatggccacaggctctctgtgtcagcggtgaagacccccaaacaggcattgttcttgggttatccacaggctgagttctgaccctgcagtgtcactgcagagcagggagccagcctccccgggaggacaggctgacagggaagacacctgagctgctttgtaggggagctgctgtcctggtagagaaggggctgctttgtgttttgtgttttttttttttttgttgttgttgtttttttttttttttttttttttttttgagtcttgctttgtcgcccgggctggagtgcagtggtgcgatctcggctgactgcaacctccgcctcctgggttcaagtgattctcctgcctcagcctcctgagtagctgggattacaggcgcctgccaccacgcccagctaattttttgtatttttagtagagatggggtttcaccccgttggccaggctggtctcaaactcctgacctcgtgatttgcccacctcggcctcccaaagtgctgggattacaggtatgagccactgtgcccagcctgctttgtgttttggaggctgcctgcatgggttccaggagggtgttttgatcaaggtgacttgagggtgcagcagccttggacatctttggtgacatgttcatttatccactcatttgaaaaatctgtttaaagttgccaccaagtcacagtaactgtatcaagaccccaaggcccaaaaaggtgactttcgtgaccccttgctcccagggggcctagagtctagtgagcaaaaaagatacaagtgagctccacagagtttgtgacagaaagtcttgtattttccaccacctacctcctttttccctttgattggtttgggtggtcacgtacccagctcaagatcactgaagccagtggtcctcgaagtgttgtccctggactggcagcatctgcatcaccggggaacttgttagaaatgccaaatcttgggccccatcccagtcccactgaatcggaaactctgtgggtggggcccagccatccctgctttaactagcaccgcttaccctgcgccagtcatatgcgtgggcacttgactgcttcttgccaatgagatgtcaggaagtatttgctgggttttggggaagtcactttcttcctgttaaaaaggccagaatcttggaaggagggggcctgcctcatgcccccttcctgctgctctatgtgtggtcctgagcgcacatatgcatggcattgaagagtcaacgtatggccaggaagggcaatgtcactgtcaccaatcggctgagcctgactgagcagaaaagaccagcccagggagttcttattaacaagacagcaaatgctttcataacattgctacttgtagccaagagcacccccaactgatccaagttcatgaggttgataatgatgtaggtatgaccagaacatctccctggcttattatgatgttgcataagtccttttcttgctctgtatctttgtgacatctgtagttcaaaaaccttggccagaccaacttacaccctttacgatggctactgtcaaaaaccagaaaatcacaagtgttggtgaggctatggggaaattagaactcttgtacactgttggtgggaacgtaaaacctttgggtgcagccactgtggaaaacaatatggcagttcctcaaaaaattgaacatagaatcaccatatgatccagccatcccgcttctaggtatgtaccccgaagaactgaaaaacagggacttgaagagagatttgtctcccatgctcatagcagcgttattcacaatagccaaaaggtgaaagcaactcaagtgtctataaatgaatgtttaagatggtaaattttatgtttgtatattgtatcataactcaacatttttttccatgtccatagaaatgaaataataaacttctttaaaattaaacttttttttttttttaagaaacatggctgggcctggtggctcacacctgtaatcccagcactttgggaggaggccaaggccggtggatcacttgagctcaggagtttgagcatgggcaacatggcaaaaccctgtctctgccaaaagcaaaacaaaaccataggttaactgggtatgggtgcacgtgcctgtagttccagccacttgggaggctgagctgggaggatcgcttgagcccaggaggtcaaggctgcagtgagccatgattgtgccactgtgctccagcctgggcgacagagtgagaccctgtctcaaaagataaacaagtaaataaaaataaaaaaagaaaaaagaaacatacatacacgactcttaaaatccacaccctttccctcatttatgtctgcagggcgatggtcactgttgttcttgcctctcctctgagttccggtctcatttatccaacagacatcttgacatctccacctggatgttttgaaggcaactcaagccagtgtgcctgggtctgaactcctgaccttccttcccaaacctgctcctcctgctgtgtttgcctttggagtgactgccacttctatccattataagtcagaaatcacctcctcctcaatctccttccctggcttaatccatttcaaattccttgtgattgtccttcctaaatacctgccaagggcggccacccctccagtcacctctgacaactgcagtggtacccgacccagctccctgtgcagaccagggcaccgcccacatccacgtttcacgacaggagccagagtgagcttttccaactgcagatctgattgatttcattctagtttcactgtcagcaatcaatgccatatgaaaatatttcacagaaaaatccaacccctcccattataaattgccatgcaggcttcttctgggttgatttctcatctagttataagggccaagctgtcttctgggtctctttggactgagtctctcaggtttggggtctgaccttgagggtgggtgggacagatgtcactgatggttgatgccttagtttgggttgtcccaggtgcagattccgagacaagaatttgagagcaagtagtttatttgagaggtgacctcaggaagctctggcagggctttaggaagcgcaacaggaaagggaggaggccaattcagggcgtagtattcagccagctggtgcagaggacagctggagttcagtcccatggagaaatcacacacaatagaggaatcccaggagcgagggacaggcggtatttatacaccaactcctatgagttattacttgggggttgttggaggtgagtgttaatcccctggcacctcccacctgccacaggtgtgggtagagtggactgctgaggtcatggacaaaagcctgcaggcaaaaagaagaagatattggcagttagaagtggctctgagcctgctggagggttccagggctatgtggagggcacgaacagcatctgctcccctggggatgatgacaggtgacactgggtgactcagatcttcttgccataacatggagacacatggttagaaagccagtccattgtctcaaggagaagagtcccagtttggtgctaataatcttaacacctttccaacactgttcatctccatctggaaccaagaaagagccagccttgggcctagtgtctttggtaggccgtcgtatgtacctacctgcaattgatgatgttgctttggtttctacttaatgttttccaataaacttaagcatataaagtttgctgttgaaataaatttatatagttaaaaaataaattgatctttaaagtgttcaatgccatcccaggctgccctccatgagacaggtggcaggcaatgcctaaatcaaggggacatagtgcacgctctgccatgggcatctcaggcctctgccctctgggttccagcccctctctaacctggttctcacttctccctgtccactctatccaccaaagccgccttctcgctcccactaagtacgttcttggctctggctttgttcccaccccacccctcttccctcctttcttttcaatgtcctgctcatgctcggaggcctgactccaacaccaccccccccaccccacctgagtccccgaccaccccctgcaacacactcccagtgggagctgagggcttcctgctggggccacccccactccaggattatttcatgctggtgctctgctattgactgttgacaggtgggtcccccaccagccccggtgctttgtgggaacagagtcctggccctctctgagcctggcctggtgctgtctcagaagagcccatggtctgtgctgagccagtgcaagagcagagtggaccgcagcttcctcctccacggcactcccgaagcccctcgggtgactccggccaaccaggtgttccagcagagagaaggaggattatgggtgtgactgtggcccttgtccttccacggctcaggccgcactgtgggagctggtcgccttttagccttttagcactggtccatccgtttctttccattgccccgtggagtctgtggccttttctccgggttctgactgagaccagagtccagcctgcctgggggcagttgtacactgccttgagtgcctggtgacagggtgacagcactgccagcgtctctgggttgggtttggggaggcaccagaggcctgagcagacggctggggttggttatggctgctgggaagggcacaaagccaggagtgggtggggcagggagaccatgaggagcctgtgcagcccgttttgtctcagcagaggggcgagtcccagtagcttccccgggccagggcgtcagctgagtcctggcagtgcaggcagcccccaagctgggcatctgggcagcagggaggggggggagcttcagggaggacgcggtgggtagcacgtgtctcaggggacacgtgtgcgtgtgagagggtgacagtgtgtgtatatgtgcgcctatgaatgtgtatgtgactgtgtgcgtgagagtgagggtgtatgtgagtctgtacatgtgtgaatgtgtgtatgtgtgtatgtgagtgtatgagcctgtgtgtatgtatgcatgtgtgtgtgaatgtatgtgtgagtgtaggtgtgttggggcctgtgtgcgtgtatgtgtgcgtgaatgtgtgtaagtgtaggtgtatgtgaacctgtgtatgtgtgtgagcctgtatatgtgagcatgagcctgtgtgtatgtgtgtgtgtgtatgagtctgtgtgtgtatgtgtgagactgtatgagtgtgtgagcctgtgtgtaagaatgtatgtatgtgtgtgtgagagtgtgtatgttgggcgtgagagtgtgcgcatgtgtgggagacagagtgtctggaggaggcagacagtgggatatgggagcagagagagcaaggcgacctccaaggagaaacggtgtctgggcgaccctgagagcctgagatgtggcctgggggttaccatggacggaagggaagtaggggggtcaggacgactcacgctctggtccttgtcactaaaagtcagagcagctgaaactcaccaagcatcactcacatcagacactggtctaagcaccttacatgcattctctatatttttatttaacaaatacttacatcgagcttgccgtgtggaggcactgctctagttgatttacaaaacgaaacaagaagcgtcgaaaacacatcgaatcaacaaaacaccatcgtgaattctcgcaactgccctgtgtgggaggcactgccgctacctccatctgcagaggggtaggggagcctgggagctggtgggcggagggccgggtggggtggaactggcatctgcctccagggctgggctcctcccattgctgatgcctgggtttcactgtgctcgtaaaagccacgggtcaattatgcttattacctgttctgcaggtgagaaaacgaggcacacaggggtgagcaattcgctcagcttgaaagtggtagaaccaggacccagcccaggccatggctcgggacccactctgtaatcactcactgggggccccgcagtaatgagctctttgaagaaaggtgagtcactgaccttggctgtgcctcagtttcttcatttgccaagtggggctctgctgcccctgcctctgccctgctgacttgcaagaagagtgaacgaatggaattggatgaaggcttccggaaacttccatcaggaaagcgccctggcctgggagaaagccggtcctggccggctttgcctgcaatgccctcagtggccagtcacgtcccctccttggcctgcaggttcctcactggagcgggggtggcccgagatgaaccctcagatgcaccaagccccacaccttgattgtccagctctgtcctgatggacaggggagctgcctgcggtgactgtccaggaactgggtgtctggagacgggcagacccaaccatttgaggctcgttctaggaagtgtgttcagtgtggccaagcttggtgactctggggcttctggaatggttcccatgccagagaattacaaaaagatcctttgtactgagaagagaaagtacaacttattctcttagggacaccttcctggagggacaccagacaagaagtccaggccctggaatcagatgccctgggccaggcagcttctgtctccccgagttctctgcggaggcagcactctcagaagattccacggtttaatcacactccagctcttttcagagcaccttctacgtgccaggcatgctctaggcaccagcgatgcaactgtggatgaaaaagaccaaggccctgttctcggggagctggcggggtgggaggggcagtgaaaaacaagtacagcctgcccccgcaagtacagtcacatagacatatgtgtgtatgtgtgcacatatacttgaaatatcaagtggctggagggtttactttagactgggggatgtggaagtcctctctgagatgcgccccctttgatcagaggcctgaaggaattaaatgagtcttccatgtgcacatccaggggaggaagtttccaggcagatggacccgcatgtgcaaaggccctgtggtggagtgtgctgggggtgttctaggagggtcagcatggagggaacaaggagaagagctcgagctgaggttatggagggcctcatgggtcatggcaaagacatctgggtcatattctgagatagatggggtggggtttggcacagaggactttatgtattttgccttaatattttaaaaggatccctctggctgcctgtgagcatggattgtgcaggatcaatgcagggagtcgatgtagggagaccagcaaggaggtgattgccacagtcaagaagggatgatggacgcccaggcctccgtattcggagcggtgtggccaggcgatagcatggtagccatcatcacaagctaaagccagcaggtttggtagatggttgggatatggaggaataagagaaagagaagggttatgctgactctaagatttggcctaatcgccagaaggttgtaggtgcctttttttttttttttttaaatgggagtgaccggcttggagggaagataaggggcatcagaaacctgcacaaacctgcaggagtgtgcactgtgtgaccctgatgcccaaaggtgaccctggggccaagcagtgtctccacccttagtctctggggcccctgcccacctgcagaagggaccctaaacactaacctttgatttaaatccaaaacattcttccctaacgtaaagttgcccagggcagtattggtttctcttttaaagacgccacctggattctattctaatggtgggggtgcatatctagaaaggatgggcagcccctgcggggaaagaatgaatggggccaggtgcagtggctcacacctgtaatcccagcactttgggaggccgaggtgggtggatcacttgaggtcaagagttcgagaccagcctggccaacatggtgaaaccctgtctctactaaaaaaatacaaaaattagctgggtgtggtggcacgcgcccatagtcccagatacttgggaggctgaggcatgagatttgcttgaacctgggagtcagaggttgccgttgtggtaggagttattaagaaattattttaggcagatagaaaggaaaaggggtccttgggaagttttcgtttgttaaagcatctccggaagtttctgtaaagcccgggctcttagagccaggcgggcaacctttgatatgcaaatgccagccattagaaactgggtcgcgagccttcttgccctttcccgacctgttcctggcaacatggccgcccccacatatccccacgtgtgtagaacattgtggcgccctgtatttgcatattaaaagactagggtgggagggccagctttttcatgggctaccatgaatgacatgcctggtcaaaccaatcccctgagccctatgcaaatcagacaccgccccctccagcctctgtatatatacctggctggtatccatggcaggtggggacctcctctttcggctttggagcccccattcctctgcctctgtacaagggagcttcttccttctcccttccttcttgcctattaaacactccgctccttaaaaccgctccatgtgtgtccgtgtcatcttacctaatttgacatgagacaagaaccctcctcccctcatcagaactgtatcacagtgagccaagagggagccactgcactccagtctgggtgacagagtgaacgttcatctcaaaaaaaaaaaaaaaaaaaagaattaatggaagaagcccggcctggtggctcacacctgtaatcccagcactttgggaggctgaggtggtggatcacttgaggtaaggagttcaagacaaggctggccaacatagtgaaactctgtctttactaaaaatacaaaaattagccgggctactcgggaggaaggctgagggaggagaatggcttgaaccagggaggcagaggttgcagtgagccgagatcgcaccactgcactccatcctgggtgacatagtgagactctgtctcaacaacaacaacaacaacaacaacaacaacaacaacaacaacaagaatgaatggaagaagattccatgagtacccagagtgctgcagtcccatgcacgagatttaacgtggctgccacctgtccagatgggtttgtgggaaagcactacatctgtttaagggagtttgaatgttaaagagggatgttcatcgcagaaaggaaattactgagtctgcaaatatcatcaagtgggagaaagacggatgggacatttatggacatgtagtttgtcccagtgaaataaagcatcttcaaacctgtctttactggcatagaagtactgcagtgtcacctaacagagcagtttacatcacagtggtgagtttctgaaaaacaaaaaacaaaagagtgctttccacccatctatccagctttctaaagcaaccgcaataaaatatgtttttgtgcgatggaatttacaaagcacctactaatcgcagaaccctgggctaaggagaagagtgaagaaacagagctcatcctcagtgggcccatggctggtgggagaaacacacggacataaatggcacgcaggatgcagtgggttggtgcggtgagaaaggtcgcagggtccagagaacggagagggtcagagaagtctttttaggagggattgtatgtgagtcagcttgctattggctgcaagtgactgaaacccctaatgaatctggcttacgcagtgagggagtatgttatctcccataacagaggtggacttcagggtgggttgattcagtggctctgcaacaccaccagtctccctcgcctgttgtgggatgtcacaatgtggctgccaccagcaactggcacatgtcttcttgtccaggtgaagcaggaaattttacccgaccccttcacaggtgggacctggagtatcggaagctggagctacccggccacttcggtgccagcagggcaaactccactcactgttgtgctcaaccccttgtgggagggagcatgtagatgagcgggttcaggagctgcggcgagtgcctttgggcgctggcaggagcaaactctgtgctggccccacagcagcgtctaagggaggggggtacctgcaaacccggaaaccccagaggacgggcgtcacagtgctcttttagctttgctgtccgcggatggcttaagtgttaaacagctcagtgggccctctgcctttttgcatgaggttgtttctctccaccagcgagagcagacggtcagtgtgacagcctttagtgtccacacctgtggcacctgagctcttattttgcatccaggaaaaatcaggtcgcatgaacgaattggacggtggtgaatatggaggattttattgccgatgaaaggggagatggaaaagggatagagcgggaagataatctttccccgctggggaacattctcttcatcctcttcgaagcaacactgtcaagccgtccctctgaagtcaagctgcttctctccaacgtccagctacttctcctcttctctgctggagaagcctggggtttttatggcacaggatggggggtggggcgtgtcatgtgtggttttggaaaggcaacattcaagtcagaaaacaggaatccgtgttctcacttcgggccatggttccaggtttgagggtaggacccttgctggggaccgccctcttctgcccagagtttctctgcctcctgtccctatcacaggtcccctggcattgagagagaaatcactccttcaagtgtgggatgtactccttgtcttcagtacaattggccatcttggcccatgtgtcccttccgggaccactgacaatcaccaggagattgctgaatgtagtaactgtagactaattgggatgaccctgaagctgaggaccacgtcagcatcccctgaaccaaggggctgcatggggaacaggtagacaccaggacaaagtcaggcttctgtcaggaggaggaacgtgaagaaggatattggttaggcagccgtctgagcagggctttggtggagtggtgtgcttttagactagcagagatgacaacaattactttttgcgtgctactcactgaaattagagctttcaatgcagagtagaatcttctctgtgcaactcccttaactcactcccctgatgcttccaagccctccgttcctctgtaagtagagggacaagcccacagcttggggctatctgccactctctgaaatgcccatcgtgttctctgcctgctgaaattcaggggtttgtttccaaacctgtttactctggatatacctggcattgcaattgcaaaacttagtaaacatagcaaacggataattaggaggggaaaaagaaagggagttgctgtttttatgaacaccaagttgaattgtctggaaagatctcttaagggcaaaaagctgaaaaagagatcagaaaaatattgagaactgcccagtaattgcccaatataatagtcattgctgcaggcagggcaccatggctcatgcctgtaatcccagaactttgggaggctgaggccagaggatcacttgagcccaggaattcaagaccagcttgggcaatgtagggagattctgtctctacttaaaaaaaaaaaaaaaattagctgggtgtggtatgcacaaccgtagtcccaactacttgggaggctgagatgggaagatttcttgagcctggggattcgaggctgcagtgagctatgaatgtgccactatactccagcctgggtgggagagcctgtaatctcagcactttgggaggctgaggggagcagatcacttgagaggtcaggagtttgagaccagccttgccaacatggtgaaaccccaactctactaataatccaaaaaaaattagccagatatggtggcacccacctgtagctccagctacttaggaggctgaggcatgagaatcgcatgaacctaggaggcagaggttgcagtgagccgagatcgtgccactgcactccagcctgggcaacaaagagactctgtctcaaaaaaaaaaaaaagggttgaaagaaatagtcattgctgcatgtgactactgagcacattaaatgtggctgatgtgactggacgtggtggctcacacctgcaatctcagtactttgggaggccgagatgagagaatagcttgaggccaagagtttgagaccagcctggtcaacatagcaggacccccatctctaattttatttaattttatttatttatttattttgagactgagtttctctcttgttgcccaggctggagagcaatggcatgatagcggctcaccacaacctccgcctccgggttcaagtgattctcctgcctcagcctcccaagtagctgggattacaggcatgtgccaccacacccagctaattttttgtatttttattttttttttagtagagacagggtttctccatgttggtcaggctgctctcgaattcacaacctcaggtgatcagcctgcctcagcctcccaaagtgctgggattacaggcttgagccaccgcgcccggcctccatctctaacttaaaaaatattttttaaaaatgtggctgatgtgactgagaagttgaatttttaattttgttcaattttaattaatttaaatgattaaaaactgatatgtgattcagttattggaaagcttttaaatatgtttggggatagttgtttatgtgaatctactttttcagctgtcaaatttctaaaatcgaaatagaagtcaagtatatctgataaacatggaggtgcactggaagggtaaaactcacaccagagtttgaagacttagaatgaaaaatgtaaatgaccttcatttttacatttattgtatgttgaaataatattttaggtatgttgggttaaataaaatatatcattgaaattaatttattctgtttctttttagtttttttttcctaatgcggttactgaaacattttaaattatgtttgtgattcacattctatttctactggacaatgctggtgtggaaggatcctgcacccggattgcgtggcaagtgttttcataccctcattccacttcaaagaagccaaaactgaacattgtagaattatataaagaacaaagacaatgggagaatccaacagcaggcccacattatgaagaaagtcattagccctggcatgaaaatattcgtcaattataggagagttgcatgttttcttttaactgtataaagctgtgagtgtaaacgggttttttttttttttggattccccacccactttagcatatttagctttcttaatgagcccgctgctggtcccagctgtgctgggttttctggacagtttctcctggttttatggcagcccttggaggtcagggcagttatgacgattctcactctggagctggggaaacaggctcagggagggcgcgcgacaggctgagggtcccacaggcagtgagcagagaaataaggagcggccagcgggggtgccagcctctgtgccctgggattctcttctgcattttgtgttcatcgcctggccctggtggctgtaccttccttcccctccatgggccacagctctggctctcataagaggatggccctggggctcctggatctgccttgcctcaacagagagctggttgtgtctggagtgcaggtgtccggaagcccagctccctgccctgaggcaggacaaggagtggctgtgactcacaccctgggctggattcccctgcagggtgggctgaagcctgcctccctccctaaggggcttggcttaaggccgcaccctggcccggcttcctgctcttcctgatcccctctccctacccctttctcgtcttctctggtgcagatcctagatccagtccttgcatgaaggtcctcctctcaggatctgcttcaacggtacctgacataaaataggtgcatgggacggtgggagaggagcattcagaaacacgctggggctccatactgcatgcttttcagacactggggcgctgggaatgcaccccttgttgcaaacctcaccttcaattcctgccccatgtaaagccttagggaacccccactcagcggaccccttcccagatgggtccagtccagcatcccctctgccctcggaggttcccagcactcttgggggaagaatagtctgagagatgctgtcctgcttggagagtagcccagcctctgccggtggtttctcgaagccctgctctttgtcttgggccaaagtgtctcctcctgctaattccctcctagaaatctcctttcgaatgtccctctttcatgttagggtggtgactggtggctttcatagagatttccacactctctttagaacaaattggttccaacacttctaactgtgggaatgcagccaaaattctgagagccctggaaaagtctggttcactggattcactgtctcagaagaggactttttcctggaaagaggcatctggagcaatattggtatcagggctgtcactgaggccccttttctgtcaagagcaccatcagtgggcagtggtcagtggtgtgggcctggtgctggccaggggtcctggaagtggctccgctgtcctgcagccatgggcccagggagcattgattctgcccagcccggctctgttcatctgtgagctgaatcccaatagcatcgttgagctcagtgaggattaagcaagttcatgcacccggagagctcagaactgcagtccccggcccgcagtaagtgctgtgtgtgtcagcccatcgtcgtccgctggtgccggtcagggtcacagatgagccttgtcaaaatgcagcccgggatcagggctttgggcttaggaagtgagatttctgtaggagcgctttgagatttagcctgtaatgagcagctttgcttctaatcgctcttgagagacaagccatcaaacattggttatccctaaactgagagcagaaagggctgaggggaggaacaatggccctggctccccctgccatgcacccactctgccagctgatgacagacgcagacggatggaggacgttccaaagtcgaggctcagggctgctgccttttctccttctgcttcttaatttaaaaaaatttatcctagagtctccgttactatagattccctgacagtctgctgtgggctaatcttcaggataaagcatcaccttttttgagtgtttttctccttcaggtttttctcttttatcttgaaaccaggaagaaacctatgctctcattcaatgctggaaaatgcatcccttgctcatttttaaaccttttcatcttcccttcattttctgcctaaatgtctcaattgtgtttatctttctctttcagggatggcagatgcttaagtacatgcaggctgtgaagtgagttgtaaataagatattgttattaggactatccctgataagaaaggcatgtcctctgcacctctaatcctgggccactgctatgcatccccacttagatgaccgactgcagtcgctcagagcaattgtagaggatggcaaggaatcaacctatttggatgaagacgttttgtgggcgggcagagaagaaaactcttgagagaaggaagcattgccaggggcatgggagcctacaactgctggtgcctcagtcccatctttgaccaattcattcaacaaacatttatcaaggaatgtctttgtgccagaccccatcctaggcatggggcatgcaagaaggacaggtccctgtacccatggaacccccgtgcaggaagcaaaacaggaaatgaacaattaaacaaatacacagtgtaatttcagatcatactaaatggtggaaaataaagtgtgttgatgtgatagcaagggactggggactagggagcgtccgggattgctgtctgttaggagatcatatttgagttgagactcgaatgcagagaaggaatctactgagcgaaaactagtggaagaagcacttctgttcaacatagcagtggaactcctagtcagagcaattaggcaagaacaataaataaaaggcatccaaattggaaaggaagaagtaaaattatctctgtactcaagtgacatgatcttatatgcagaaaaccctaaagattctacaaatccccctgttagaactaataagtggatttgacaagttgcaggatataaaatcaatgtgcaaaaatcagtgaatatgaacaattcagaaagaaaattaagaaaacaattcaatttactatagcatcaaaaagaataaaagacaggaataaatttgaagaggcagaagatttgtaccaaaaactataaaaaactataaaaattgctgaaaaattaaagcagacacaaataaatgcagacaccagatgatgctcatgaatcagaggacttaatactggtaaaatgcccttaccttccaaagcgatctatagattcaatgcaacccctatcaaaattctaatttttttgtggaaatagaaaaatttatactaaaattcatatggaacctcaaggcacctcaaatagccaaaacaatcttgaaaaagaagaatggttagagacatcacacttcctgatttcaaaacttactgcaaagctacagtaatcaaaacagtatcatactgacataaagataggtgtgtagaccaagggaacagtacagacagcccagaattaaaccctcacatgtagggcagatgatcttcgacaaagatgctaagaccgctcaatggagaaagaacagtcccttcaacaaatggtgttgcaaaaactgtatatctacatacaaaagaaccttttatcatatataaaaattaactcaaaatggataaaaaacctaaacacaaacctaaaactgtaaaactcctagaataaaacataagagagaagcttcatgacattggatttggcaacgatttattgaatgtgaaactaaaagtgtagacagcaaaagaaaaaatagatacattggactacagcaatattaaacactttgcatctaaagacacagcagagtgaaaggtaacctatgaaatgggagaaaatgtttgaaatatatataaggggctaatatccaggatattaaaaacaaactcctacaactcaacaacaaaaaaagaaataaccctattataaaatgagcaaaggacttgaataaagatttctccaaagaagatatacagatggcccataaacacaagaaaagatgctcagcaccactaatcattagaaaaatgcaaacccaaaccacaatgagataccatctcatgctcattaggatgtctactatcaagaaaacagaaactaacaagtgttggtgtcggtgtggaaaaactggaacccttgtgcactattgatggaaatgtcaattgtatacccctatggctataccctatggaattataccataggggtataccatgggggtataattgtataccataggggttaccatgggggtataattgtatactataggggtataccatgggggtataattgtatacccatatggaaaacagtatggctgttcctcggaacattaaacatataattaccatgtggtccagcgattcctttctgggtatataccccaaaaaattgaaagcaaggacttgaagaggtatctgtacacacaggctcatagcagtattatttacaatgtccaaaagacggaagcaatccacgtgtccattgacagatgaatagataaagaaaatgtggtatatccctacgatggaatattactcagccttagaaaggaaggagattctgacacatgctgcaacacggatgaagcttgaggactttatgctgaacgaaataagccagtcacaaaaggacaaatacggtatgattccacttataggaggtacctagagtagtcagattataaagacaaggtggaatggtgaccgccaagggctgaggggaaggagaatggagtcgtatttaacggatacagagtttcagttttgccagatgaaaagttctgttgagggatggtggtgatcgtagcacaatggtgtgaatgtagttaatgccactgagctgtacacttagaaatggttaaggtggttaatttatgtgtgtaatttaccacagttaggaaaaatgatcagaagagagttccatgcttagggaacagcaaatgcggaggccctgtgggtaggaatgagcttggcagatttgagacaaaggagtcctgtgctctgggagcaaagtgaatcaggtgggggagtggaaagaggtgtgaccacaaggacagacaggggacagaacaggctggatcttctgagtttgcatttgatatcagagatgtgaaatctgagattcacaacaaagatccccagtaacttgcccaaggtgaaatagtcagtaggtggcagtggcagggagtccaagtggttccctaacagattagctgtttccccttcttccttagtaatagaactactgctgactatcagttgtgcctatggtcacccagagtcatgactacctttcccagcccctttgcagctaagcatggcaagggaacttagtcctagacagtgggaaagtaggcaaaatcatcatgtgcaactttaagggtgtgtccttaaagacagaggtattctcttctttatcttttgtgctttcctgctatctggaatgtcagtgtgatggttggagtttggcagccatcttagacccatgaagcaagggagagtgacatgacagatgggagagtgtggccgacattggacttgggagttgggagggctcctgaggtggtgtcacttgacctgccttgtctgatgaggaggagccagtggagggtgggcatatttaagtaaggtcactcctggtagaaggatctgaggtgggacaagctgggagtaagagggggtggtggttggacacagcagggaggctggagggactgagggcaggtgtgaggggagcttgggcagagacaggagctgagagggggcagggcctggcccatcagtcccgtgatggggacactggaaggttgtggtcagagagctgcccagggctgattcagcatgagaaggatccttctaactgctgtgtggggaaggggctgctcatgaccaggacgggaggccagggcaaggctggggagccattcagggtcagcagatgctggaagatggaatgggaagcacatgttctgtagagtatagagtggaaccacctgcgggatgatgggccagcacctgccctggactcagggacatctgtggctgatgattgtgataaagatgggggatgacctcagagctcccttcccagcctgcgtttctgcagggaaatgtcaaatccagggaatggaattgatcccagcataaaaaacacatgacactgtggagccaggaaggaaggtcatgagaatgttatcagatgccatataatactcaatataaaaccaatcaataataatcagaagtaatcaatataaagccaataatcaatataaaattcaacgcaaccgtaatgagggtgatgatgcctaacattttaaacccttgcatcccatgggcagatggtgtactgagcactttactggtattttctgccttaacttgtctgataatcctatgtaacaggaactatcattatcctcagtttatagaggaggagactcaggcacagagaggtttaaataacctgcccaaggtcacacagctagtaagtggtaggcagtgggctgggatttgaacccagagaacctgcctcccatgcaggtgttgtgtgcaaatttggctcagccaattggattctcttgtctagatccaggaggtcttcacctttctggatatctggctcacttgcatcctgtgattgtgcccccccagagtgagggggtgcatcagggctgaggatgctggtttgagtctttgagcagcatgtgagacaaaccgagcagcagatgtggccaggtgggaaagccgacacctcctggactctcgaaggctgaactggagacccagggacagggacgggagggtcccatgggagtccccaactcttatcatcatttccgtgttcatttgttcttgggagaggggacatcagagcctccttcccccattagaatttttgctccaagaaggggtttttgtttgatgtgtgtctctagtgccttgggcagttcctggctcaatatgtatagaaatattattgtaataaagatgagggcagcgaccttatctgtccctttcaacccagcacctagcagagtacctggcatgtggtaggactcaataaatatttgtagaatgaatgaatggatgaatgaatgagtgacatctctcaatccttccccatacctgcctcctctgtcttcaggaccctttcctcctcatctcattccaacatccctgttttggggctttcttgggtggatttggggccccattgtgctcccccagtgcctgttttaacagcctccctcctgccaagatgacaaatgtctctcagccctggaagctgaggctgcctccactgtgaagctgataccactgttggaagatgcttcctcccacattggcactgctctgctgtgccccggggttgcggcacctcctctgactggcccttcacttcagtcacactcctggaaacaagttcccaggcagaccccgtccccaaagtctaggattcaattgtctgcttataccagtgctaaaaacagcatgatttcccccaactcagctgcacctgtgcagacaagaataagacagcatatttttagcaggtaacagactgcacacatgcaggctataattagcatttcattcaaagggaggagtttcccatccaatgcaagagtgactgaccacggggtcttctcactgcagcctctgtctcaggtgcctggtgcaggaaggagccagcagcactgagggagaccctggggttccctgggcacccaggaaaggggtggggcctttttggatattgctcccgtcactgctcatacctttctctctggcctgtccagagccttggtcctgcccagaccctagtgctgtcctcctgtgaggatgacctggccaggccatgtgatgaaggtgccctgtcaggttggtgtggggcttgcaggtcctctgtcctgcactcaagctgccccatgggggacagggacagggctggggttacccagctgtggcagagactgctggatgacctcagcatccctcctggtagcagtgagcctagctgcctggaataaagactgcatttcccaggcctccttgtgaccaaaacatggccagtggggtgtgaacattgtctttttttccttctctttggatgggagaaaacagggtacagatgtctgggatgaagcagaaggcaacggtctcaaaaatccgaggataaagatagaaggaggtggggcctcagtttcctctgctgtaaaatggaagagtaattatgtctatgttctgtggtttctgtaagttaagattctttcagctgctaagtgaagaaaaattaaaccccaatggtctaaggcaaaggtggatttattggctcaggtaactggaaaaaaaatattcaagaaagaggctgactcaggcatgactgtttatccatagcctgggggacctgacttgcctgagttacccgtggctgttattttccccgtaaatttgttcatgtgaccagcaattccggcttgaaaggaccatagaatcttattgtaaccccagtgtttaaatcctgagcgcacgggatgtccaaaatcatcatcgtcacgatttctgccattcacagagctgacatttttcctgctcctcccagctcttttttctggcctctgctaaggtcgaattctccactctgcatctcacagctgcccttcttgcttctgcaagggtccctccatccaaccacatcgtgggcttcttcttctgcttttcacatctccaagttccacatccccaagtagctaatagagacacattttactgaacattttggagcaacccaggagtgtgatttcatccatgccccggtcctttggccatttctgccaactctaacatcagtgtatgttgcttagcaactccatttttgtttttattaagaaactttaattcaaaaggaaaactctatcaccagagtaaatagaaaaccagcatcttttccatgcaaaaggatgatgactgtagaactaaaagcaataaacctaaacagaagggcttcattctgcaggaagcccggggcctgtcctttctttgttcaaaaggatgaaatgcaaggtctggaaaggagctaaaggcgcatcagcaccaaatcaaggtgttttctttgaggtgactgaagaattggagaagaaccactacaggattcagcgatcttagtgctagccccgtttgctttgtcaaatcatctcatgtttatcctctgggagttcctgagctaggagggctgttgcggggctgggagaagggagttccaggcagcggggctagcgtcacacaggcctgacaggaggtgggggccctggttcaaagaagtagcagaagcccgggtgtggtggctcacgcctatcatctcagcactttgggaggctgaggcaggaggatcacttgaggccaggagttccagaccagcctggcccacatggtgaaaccctaactatttttagtctctatgaaaaatacaaaaattagcctggtgtggtggcacacacctataatcccagctactcatgaggctgaggcgaaagaatcgctttaacccgggagacagaggttgcactgagccgagattgagccactgcactccagcttgagcaacaaaatgagactctgtctcaaaaaaaaaaaaaaaagtagcagagagaagccagtgaaacaggaggaaagcagaggaggtggaagaggagagcaggcaggggccagatggcacagagcctggcagccacagtcaagggtgctgccgggctggaaatctggggcatgagggcgtcaggtgagtgctcttaaaatccaggtggcctgggaaagagataaagcatgggggacattcagccaggcaggaccgggtcccacccatgtgccacccccagtgtggcctctgcccctccctcccagcaggtgaccccgcatccctcggaggctgaggtgtggggtaagtggaggctttgagtctttatttcctgagcccacgtgtccctgtctctcggcagggaccctcggccagctcaggggtaagaatgcagtgacagtcagcggtgatgtcccctgtgaagagccctgattggatttccgaggcatctccagccatgagggccgcagacaggccctggccagggacctttatccgcatgcctctcactcccctgattgaatctatcgattccctgtctatcaccaccttccccgagacacaaggatgggatggtttaaatgatttacttatttcaagccactggggcttggcagaaaaaccaataggtgaatgttagaatgttttcccttaattattcaggctctctgaagaagaatctgaaatatctcgctgtgaatggagccaaggtagagatgaggctgcagctgcaggaagtgttctctgaaccacctgccctcctgcctgggtccccccacggcacaggtgtatttaattcacctgtagtcagtgaatgttggtggagcacctctgccacattgagcactggtctagctgcagagacacagagatggaaaccatgcagcctcggacccttcagctactcacaatctattgaaagagggggtgtgtttggggcatgattagagctatagtttaaggatggatagaccaggttaggagcgcagtgaagaggaaattcatggaagggatacggaaacagagctggaaatgtacacaagggtgaggatatttgatgcttaagaatttttaataaattatttccttcttttgtttctttgaatacaaaagaaacctttacaaaatttaaaaaataaagattataggccatgctctgatcattacaaatgacattaaaataaatggtaaagagatagccctggccagatgtggtggctcatgcctgtaatcccagcactttgggaggctgaggcaggtggatcacttgagctcaggagttccagacgagcctggccaacgtggagaaaccccatttctaccaaaaatacaaaaaaatggccagatgtgggggtgcacacctgtggtcccagctactcaggaggctgaggtgggagctctcatttgagcccgggaaacaaaggtagtaagctgagatcgcatgccactgcactccagcctgggtgacagagtgagactctgtctcaataaatacataaataaatagaaaaaaagatagccctgctaggaatgctctgtgtcttgattgggatgatgtttacttgagtagacacatttgtcaaaacgcattgaatgggacagagaacagtgccttttactggggaaggaactctctcccagataactcccagatcaaagcagaaaccaaaactagaatgatggtttctagaaaacaacaagaatagtttacaccagcatctgagggactcggctagtgctgtactcagaagaaaatttatagtcttaaatgcttgtattgctccagggtttcaaaagggcgatggtaaaagtactgagttctcaaaaaataggaaaaaacaaaaaacaaaacaaaacacaaccaaaaaaaaaaccctaaataagccaagataaaatggggagaggaaattaaagataagagccaacatcgaatatgcacagggtgtggacggtgagtttttgggggagttagtgatgggagcacgccgcttcggaagtgtatttttccatttcaggagctggagggtttttacgcagtggagtgaccatgcgtggagctggatggagaaagaccgtggaggctgcagggtggaaagctgactggggaagactgatagtcactgtctgccttgcctgttcttgttctcttcctgggctctaagatttctttctttctttcttttttgacagagcctctctctgtcacccaggctggagtgcaatggcatgatctcggctcactgcaacctccgcctcctgggttcaagcaattctcccgtctcagcctcccatgtagcttggactacaggcatgtgccaccgctttcggctaatttttgtatctttagtagagacagggttttgccatattggccaggctggtcttgaacccctgacctcatgtgatccacttgcctcagcctcccgaagtgctaggattacaggtgtgagccaccacgcccgtccaagatttcttttccttctctaaatcattacagggggtctggatgctagctgtgccctgccgctgggttatgcagcccagaaatgaaatttcaagagagtgggttcatctgtgccaagtcacatcttcaccaaagaaatctgggctctgatggggtctgcgatggacttgtacgtgtgccatctgggggatggagggtggggtggtggccaggacgggcctgtctgggaaagaggcttccctgagccaagacagtgggggccacaggggactctgggatgggaaagccagcccagccagggtccttgggggatctggaggggacgtgacaaagcaggagggtaggaggggagccaggagtgggaagctggggaagccagagcagcagaggctggagcaaatcccgtgggaaagaaccaggaatgggtggttcctgagggagtggctcaaacaccctcgcaggggggtggctcacctttaaagaatgtcttgctcaggccgggcacgatgtctcatgcctgtaatgccagaactttgggaggacaagtgagacgaggttggttgcagtgagccgagatcgtgccattgcattccagcctgggcaacagagcgagactccatctcaaaaacaaaacaaaacaaaaaatgccttgctcttcctcaatcaaaatccccctgggagtaaaagatactgaatgatagcatacataagaaaagtgcccaggccaggagtggtggctcacacctgtaatcccagcactttgcggggctgaggtgggttgattacttgaggtcaggagtttgagaccagcctgggcaacatagtcagacctcatctcttaaaaaaaaaaaaaaaagaagaggaagaaggggtaggaggaggaggaggaggaggagaagagaaagaggaagaaaagaaacgtgcccagatcataagagtacatttcaattaatcctcaccaggtacacgctcctgtgcccagaccctagataaagaaacagcaatctcactacacagagtccaactgaatgcctctcagagggccacattctcctcttcagtgttgaggaaattggatccaaaagagccttgggtctcttttggttgtttcatttgagtattctatgggcagatttttatgtattggacttcttgaaatgggacttacctgtgcttaatttatcttgatttcagcccactgggtaataaatacaatggacccttgaacagcacaggttagaactgccagagaccacatatacgcagattttcttctgcctctgccaccccgagacagtaagaccaaaccctcctcttcctcctcctactcctcagcctactcaatgtgaagagacaaggatgaagaccttcatggtgacccacttccacttaatgaagagtaaatgtatactcccttccgtatgattttcttaataacattttctttgctctagccgactttattgtaggaatacagtatatgatacatttaacatacgaaaactgtttatgttatcagtaaggcttctggtcaacagtaggctatcagtagttaagtttttgcagagtcaaaagttatatgtggatttttgactgcgtgggatttggtgcccccaactcccacattgttcaagaatcaactgtattccaaatgacagaatgtaatgccagacatctggaaaagactgatacagttttccgaccaccagaagaaaatccacccagggaattggtcagcggaggcaggcactcaggtttcacggagccatgagttggagggattctgccagcttgggtgatgaggggctcacaggtcccaggaaggtggcagtagcctgggagctgcttccttgaaaactctgaacgggctgggacctgtggagagggacaagcgagggctcaagggatgggtctgagctggtttttaaagtttatctgtgttagagaaactgccgctccaacaccaagaataaatcagctccatttcccatcacctcggttgcttctttttcccatctcttcctctctgtaagttttgcctaagaaaaatgtatcatgttttctgaagacaaccgcttccccctcctcccttgtgaacagtcaggcaaagaatgaatttagatttttttgtagtgtcaaggcctctctcattaaattactcccaccatctcttgtctctcctggtgagtgagtttaatgatctcttgctccttactctcttgaaaactgcctcgtgtgcttctggcttgggcaatcttaatgctttgggcagctttcagtttcctgactgtagcttgcactccagacttcatccccagcccgtccccatcctcttctccgcccagcgcttcccatcttcccacattcctcttctcatcccctgttctctctgcacttatttgctcactgacattcccatattttctacttctactgaaatcctgattgtatccagtcatgcttttttgattttttaaaaacactgaaatgtctgtaattccaacactttgggaggccgaggtgggcggatcgcttgagcccaggagtttgagaccagcccaggcaacagggcaaggccgtatctctataaaaaatacaaaaattagccgggcatggtggcatgcgcctgtattcacagctactcaggagagcgaggcaagaggatcgcttgagcccaggaggttcaggctgcagtgggccatgatcacaccacggcattcagcctgggcaacagagagagcgcctgtcttaaagacaaacaaacaaacaaccctgaaattttggctcacacctgtaatcccagcactttgagaggccgaagtgggcagatcacttgaggccatgagttgaagaccagcctggccaacatagcgaaatcccgtcgctactaaaattacataaattagctgggtgtggtggcgggcacctgtaatcccagctactcggggagactgaggcacaataattgcttgaacctgggaggctaaggttgcagtgagctgagattttgctactgcactccagcctgggcaacagagtgagacttcgtctcaaaacaaacaaatacacacacacacacacacacacacacacacacacacacacaaacacaaacaaaaacccctgaaatgtgatgatgaccgttgtgtccttatcaacagccattgcttgcctgcttacgttagttgcagtgggagggtaggcagccagaagtattgggcattcccctggcctgtgcattttgaatgatgaatacaaaactgctcaattcaccaaaaacaatcatgtaagaaaggaacgtttcacttcttcttatgggcccctgattgcatgtgatgcaggtgacaattacatatgtccccttaacagtttggaaaattctagtgaagagaggagtttaagtcccttcacactgaactgaaacaattaattctctataaaaatctccgcatgatggatcatgttgcatttcaaacctctacagactgtctcatataaatatctgtttctcttttttgagacagagtctcgctttgtcacccaggctggagtgcaatggtgcaatcttggttcactgcaacttctgcctcccaggacctgcagaggtcctggtctcagagttcatgccctgcagttgctgtgtgtccagcagctggcagggcaagagggttggggggtgggcgtcacccccacagacacacagcacccggcagaaccctggcctaaaggcgcgcagctctggggtctcccaagcccacctgggagtaggcccatggggacagctgtgggggacagggactcccaatgtacaaaacaggccatgagctgggcaagctactccttctcataacctcagacctttcttctgacccagtcaggaccagctcctgggagcctgcagacaatcctgggcccagagaagcaggcagatgtggctgttggtagcactaatatgggttgtgaatatcatcctgtggttattactttacttacgttacctgccagtacactcgatcctgcatatgtcccctcacttcacgctcacggggtttgaatgatgggacgagcactcccagcaggtgatgagggtgataaatggcacctgacattcctggagcacctgttggtgcgcagggcggggcttagtgctctgtttgagtctggagactttactctgcaacagcagctgtgtgacccccggtaagtggtttaacctttctatgcctcttctttctcaactctaaaggtggataataaagtccctgccctcaagcaatcaaagatgtgtaagaagggcctggcacatggcaggcaggcagtatacatggttgggattaaccccactatacagatgaggaaactgaggctcagaggcactggcctggcaggaagtaggaccttcgcccaggcttgtctgatgctgagcgctttggcctccatcccttatggctgctccccactccacactgggacagatcctggagaggcaaaccccaaataccctccctaaccagaaaccgaaataccaaaatccactagatcccagcccttacagctgccttcagaagggacagagcagagggccaccccctcacacgcacacaggggctgaccatccaaggttgccaatcacctggctgcgagcagccctgttcccacggggacactgaccgctccgagtgcccggcattcaggcctcgagccacccactctgcactgcacggggcctccttggaacgcgtccctccccagaggccgtttctctgtgggatggcgctgctctgtggggaggaccccacctccctccttcacgacgacctgccctcacctggctcgtctcttggtagacactgtcccacgcatctctgtcatttgcatgccaccgtggtgacagtcttcctggccacgggtgtgacagggccttttagtttctgactgacacagtcacagcccgatttcacctgattccacttacaaaggcaggtttcccttcccagcctcacatggaggtggtctccgtggagttcaagaggatgtgggctgggaggaggggcagcaaagaaccccagcacaccccaagcaggaggtggcagggtccgtccggccatctggagacagccaagacccttggccactgcagatccccccactgagcctgcccccatccccactccacactggaacacatgctggaggggcaaaccccaaataccctccctaaccagaaaccaaaataccaaaatccaccagatcccagcccagcatggccagatagtctgactttccaacgaagtcgaaaatacagatttttagaattaaaatgtaaatgctggcaactaattcaaattcaattttgtggtggtgtttttttgttgttgttgtttttgcatggagggctttctggtgaaaaccagaccccacctgggagcaggccccggggggatggctgtgggagaaggggaccccttccccgcaagtacaaagaacaggccacgagctgggcacagatgcctcttcccgagcccacctgggagtgacaaccggaaaacgtgctagacaaattctgaaagagctggaacaccttacattattttaaaagtccccaggttgagttaatcccagaccctttacagctttttccttctgattggtgaggcctcagctcaaatgtcacctcctcagagaggccctcccccatggccctatttaagtagcccccaccagagtctcagtcagcgacacgcacccttcatttccttcttggcgctgacccctacctgcaagtgcctcgtcatttgcggttggcatctgcactgtccgtctccaccagcacttaggctccgtgaggacagacgcacgtcgccttgtgccctggtgaatcccaaatccctgccctgagcgcagtgcctggcacagaacagacacaggcaatgagtgctgctgaaagttccccatggagccagtggtgatctgtccaggctctacagccctcccgctaaacgtgttcagagacggggacgctggggccatcctccttgctccactcctggtgaagagccctcagacccataagatgggcttgtccatatcaccttctcaggtgagcctcatacataagcaggttcagtgggttaaccaagcctacatctttaacccacgtgataaccacagtaccaggtttctgccatcaaatcttttctatcctcagtcctgccttgggaattcaaactcacccagaattcagagtttcacagactcagaagagaatgtgatgccagattgttctgaaatgtttggttttaaagcaagatcaaatgattacatttgtgatctgaaatcatttgattgtatcaagccatatccccttccaaattattttctttaaattctccccagaacggggagcagtattaattgtttccaatgaaaagactgcccctttcatcaaagccatgagctttatctgctgtttttgaatataacactggcttagtgaaagtgattgtaaatagcaggtcttctttgtgcattttgtgcttccaaatgtgctacttggaataaagaagtgaaaagtttaaaaatcctctcttgtaaatgtttggaaattgcactagagttatttcttgctctttgaggggagaggtcaccctgcaaacatacagtcacacctgttcggctcccccgggttttgaatgtcactaaacccccacttcccccctaccttggcaggtcagactctgtgaaggacgctcactgtctgtacgacctcacaccaggcacagggactgggggaaagagacacatctggcttgtgggacattcctgcaaggccagttttctggtagggaggtgacacctgcaaaggaatctctcatttctcccagctccagccagtttcaacaacaggtggggttttctttcctctcaattgttatagatttcttttctaataatcaaagtcatgactcattttgaaagtttttaaaaatagaagaaaacaagattttaaatcacacgtgataccaacaccaaagataagcagcattcgcattttgctatgtagtgctcctgttagacatacacacacatatgatcacacttacacacttatgcatttttgcttcattaaaatagaatacagctttatgggccaggtgcagtggttcatgcctgtaaacacaggcagatcactgaaggtcaggagtttgagaccagcttggacaacatggtgaaaccctagctctactaaaaatacaaaaaaatagctggatgtggtgcatgtgcctgtaatctcagctactcagaaggctgaggcaggagaattgtttgaacccaggaggcggaagttgcagtgagccgagatctcaccattgcactccagcctgcacaacagagtgagactctgtctcaaaaaaaaaaaaaaaagaagagctttgtttacactaaacaatattttgtgtccatatttacacatagataacaacagatcactatcatttttggtatgggcatatgtagatataagtattacatgaatttcctactttttatccagttatggtcatatcacctatcagtgatttaacttcagccaagacagaagtttatctcatgaaaaccaagactgggccgggcacagaggctcacgcctgtaatcccagcactttgggaggctgaggtgtttcacttgaggtcatgagttcgagactagcctgctcaacatggtgaaaccctgtctctactaaaaataaaaaaaattagctgaatatggtggcacggaccggtaatcccagctattcgggaggctgaggcatgagaatcacttgaacccaggaagcggaagttgcagtgagctgagatcacgccattgcattccagcctgggcaacagagcaagagtctgtctcaaaaaataaaaaagtaaaaacaaaactggaggttctcagtctagggtggcgttagggactttcatttccttccagaggacattctgctatccgcagggtagaagcctaatcctcaaggttcaaggtgacaagaatagctccaaccatcatacgcttattccaggaagcaggtcaaaggatggaacaactaagaaatgacattaaagatatgtgtcagtccatctgcgttgctataaaggaatacctgaggctggttatttatagaagagaggtttaattggctcacagttctgcaggctgtacaagcatggcaccagcatctgctcctggggaggcctcaggaagcttccaatcatggcagaaggtgaaagggaagcaggtacatcacatggcgagagaaagagcaagagagggaggaggatgtgccaacccctttaaacaaccagatctcccataaactcagagcaagaattcagtcattgccatcaggatggcaccaagccattgtgagagggatctgcccacatcaccaaaacacctcccaccaggccccacctccaacatcagggatcacatttcaacatgagatttggaggggaccaacatccaaaccatatcaagacagaagttacagaagggggtctccaaaaataccacccaacacttttattgcctcccattggccagaacctggtcacatggccacaactcactgcaaggaagcctgggaaaatgtagcctgtgcccgcccactaggagaggggagcactggtgccagggtgtgggaccaccagtgggcatttatgcttcctacttctttcttcttataaaaatccttgagattcatctttgcatatttttctgactatttcctagggatcaatgcctataaatgaaatttgggaccaaaagttacgcaccttcattggccagttgcaaaattgccctctagaaaagttgtaccaacgaactcacccaagaggtggggttctatttcatgaaatgtttctccaccccacatttccttttaatccacaccctttggcctttattaggcttagacatctcttcagaatccgtgcttcctacatcataatcttgggattcaatacatgtttttcattcgggttattattaatatcagatttatctaactatgcgtgaacccagccacagccttagggaaagagatgtatctttcagtgctgaagagaataaaaatgaataatcctcagagactttgaaactgaagtgggcaggcaagggtggaaagaacagatctcattctacgaagtgcatggagggatattcacagagcatgtagtgctgagtagagcggaacaggcacccggggacacccagagagcagcctttcctcaacagaaaaggagtgagcaccacacagagctgcagaaagggaatcccagacaggggtaacagtagatgcaaaggccccatggcaggcaccaacttgtccaggtttgcccagaactttctcagttttaacactagaaatcccatatcccaggaaaattctgagtctcagccaagctgggatgatttgcctgaaactgccctgttataaaactgagaggtctgtgccccatgaccctcctcagtcctgagcaagctgaggcagtgggtcgccctagactggaacgacatgcatgatggtgggaagagccagtgactctctttcatgtcctctctcccctcaacctcaggagtcacccaggtgggcactggcatccaggatgaaaacttcccagcacccctagcagcaagcagaggccacgtgaccaggcagtgaccaatgcacatgaggccagtgcacagcaactgccattagaggaaggaagatttgtgtcctcttgttctcttctcccctccctgctggctggcagtagataggatggacactgtgggggaagctataccctaaggaagtcagagcagcaagatggaagtagcctaagaccctgaaaaatgcacagagaagaatgacccgactggcttggactttcatgtgaaaggaatgaacctctgtcttagtaaagccaccgtcattcagggtccttgtcacattcactgaggctgtaacataattgttagaaagaacaggagcgggaggggggatggagtcggagaggcaggcagaggtcagatcacatcgggcccgtaggccaaggcggaggaagaaacaggcaacataggactcaaggaccacacctgctcccaggcaaagggagtttgctgtgggtgcccctctctgtctgtgtgtccagtgtgtggatattctttataccttgcccatattgtacaaatacttttttctattcaatatttagaagacattgcattaaatagcaagatggcagatgaacatcaggaaggaacattagggacatccacagtgttccatccaggaaccttcaccgtggaaacccttgtgctcatgggcgtggtctcaacacacagtcagctgttggggatcagaggccgcactcaccggagcagtgaggcagaactaactgggagagggtccttctgtgacacctactgcatcaccgggctgtgtgaagtgactcagctgccagaactcacacaatatcattctacaccaaaacctcatgggaaaaatggtaagttctcagtttctccattaatagcaactctcagattaatcgctgtcctccatcgcttctccatgaaacaactttttatagctttgcttgcgtctatttttccattttttttaattttgctaactgattgaaagatatatattgtgtgtgtgtgattttgtctctgtcagccaggataatcatggtttaattcttattatttttattaccaacatcctttagttttttaagcttttcaattcctaagggtattaatcaagatctttctgtctcatgagacacagaaaacaaatccaaactgtgtaagaggaaaaagaatgcattcatcactagcattgaggagttcccaagcttagcttgcttggggtacagctacgtctaccatttccagggtcatcctgtaactctctctctctgcttccccaactttggctccatgtttagctccacgaccctcaggcttaaacagctgtactggccgctccccagatctccagctccctgaccctcaaactccaactgcagcaccagctccgccccgggtctccagctccacaatcctcaaactacaacagcagcaccagctcccctgtggatctccagctcaatgactctcagacttgggaggcagcaccggctccccaccaagcctccagctccacaaccctcaaactagaaagcagcaccggctactccctgggtctccagttccctcaaacttcagctatagcactggctcttccccgtggccaccagctctgcaaacctcaacttacacagtggtagcaccagctcctccctaggtctccagctacacgaccgtcaaaattgaactgcaacaccagctcctctttggcctccagctccacaatcctccaacaacaacagcaacaccggctcctccctgaatctccagctcaacaaccctcagacttgagaggcagcaccggcacctccccaagactccagctccatgaccctcagatttgaacagcggtagcaccagctcctgtccaggtctccagcttcacgatccttaaactagaacagcagtaccgccgcctccgtaggtttccagttccatgatcctaagacatgaatgaaagaactgggtcaccccagggctccaactccaagacccacagatttgaacggcagcaccggctcttcctgggatctgcagctccacagccttcaaactagatcagcagctccgactcctccctgggtctccagctacacaatcctcagacatgaacaatagcaccggctcctccttgggtctccagcttcactactgtcaggctagaacagcaacaccggttcctccctgggtctccagctcaatgactctcagatttgaaaggcagcaccggctcctcacaaagtttctggctccaaggccctcaaactagaatagcagcagctgctgcatcttgggtctccagctccacaaccctcaaagtagaaaagcagccctggctcctccccgagtctccagctcctcaagtctgagggttgtagagctggagacccggggaggagtcagtgctgctgttctactttgagggtcgtggatctggagacccagggtggagccggtgctgctgttctagtgtgagggtcatggagctggaagaccccgggaggagctgctgctgctgttctagtgtgagggtcatggagctggaagaccgcgggaggagctgctgctgctctcctagtttgaaggtcatggagctggagacccggaaaggagccatttgaacagcagcactggcccctccccaggtctcaggctccacgaccctcagacttaaaaagctgtagtacgggcttctccctgggtctccagctctacaaccctcagacatgaacagcaccaccggctcctccccctgtctccagttccacgaacctcaaactacaacagcagtaccagcctctccccaggtccccagatccacgaccctcaaaatagaatggcatcatcagctcctccctgggtctccagctcccaaaccctcaaacttcaacggacacagcagatcctccccacagttaaacagcagcatgggctgttccccaaagctccaaatccatgaccctctgacttaaatggtggtagcaccagctcctccctaggtctccagttccatgaccctcaaactacacagtagcaccggccccaccccaggtccacagctccaccaacctcacattagacactaagactacctcctccccactctccagctacacaaccctcagccttaaacaacagcagcaccagctcttacctgggtctccagcaccacaaccctcagccttaaacaacagcagcaccagctcctccctgtgtctcaagctccacaaccctcagactagaaccgcacccctcctccctgagtctgcagctccatgaccctcaaactaaaacagcaacacaggctcctccctgaatctccagctcaacaactctcagacttgagaggcagaaccggcaactccccagaactctagatctgttcagactagaacagcaacaccggttcctctctggatctccagctaagtgactctcagacttcaaaggcagcaccagctcctccgtggatctccagatccacaacattcaaaccaacatggctcctccctgggtcttctgtttcacgatccttaaattagaacagcagcaccatcttctccctgggtctccagctccacgaaactcaagctagaatagcagcaccggctcctctgggatcttcagctccacgaccctaagacatcagtggcagcaccggctcctcccctggactccagctccaggaccctcaaacttgaacagaaacaccagctcctccccaggcctccagctccttgaccctcataaacaatcccttctcatgaaatgtagcagtcaggaaaactgtagaggaagtaaataaataaatgttttcctttcaaattgatgtttcttttctgttcacgcaagtcagaaaacttttctactttccatcaaccttgcaacctgcttgcattcatttgtaagatggaaatccatcatttgaaataacctttaaaaacttagtagttcttttttactatgatcttatctcacagctctagaaacgatctttcactttgcctgtgcagaagtcttgtgaacattcaaactatgaatttacttggttgagattcctagaatacacattatccccagatgttcctgcccttcttaaaatcttctaacacgttcccctcacccgagcatacgtgccaggtcctatccacagcccacagtgcccagcacggccctgccctctgccctgaccttatggtctcccctctgctgttactttcctcccagacaggcctctgtcacttcctcaaaccacacaggttcaggcctgactccgggcctttgcccctgctgtgccccctgcgtggagcgcctttccccggctccccatcctcctctccaccggctcagctccagcctgctggctgcccctcagtccatgaacacacgaagtcctccccccaggcctttgcacatgctgttctctgtgcctgaaacccttcccccctcaccatctgcgttcacttttctaatttccgttcatccttggagtctcccctgaaatatcgccccccgcctgcccccaccacttggacttaaccttgctcaggttgaaaacccccatctcctgactccaggaagctagatgctatcctggcacttggaactttcccatcacagcgttttgcgcactcgtaatttattctattaggttggtgcaaaagtcatcacagttttgtcattgcttttaatgaatggcagctccggctcctcccgcttttgattgccattacctttactggcaaaagccggaattactgctgcatcaacctaatagaataatttatatttattcacctatcatctgtcttcccctctagaaagtaagctccatgagaatagggaccaaatctactccaatcactccaccttcctagcacattgtcaataattattcaccgactgactgatggagaaatatcttcattgttgctgggatgagccacataacatgacatgcccctttgaaagtcaatgtcatggacagttagcatttgcttttcactcctgcacctgtggcttggctgggcttaggctgatctagtctgggcttgactccaggctgagggttggaaccctgcgtgctccacacgcctctcatcctgcagctggagccgaagttccctggggcacgctcgtctcgtgggaaaaatcaagagcattagagggcaggcctggcagtgccaacacattccaggcttctgcctgtgccgtgtctatgaaaaaatcttgttggcataagcaagttacccagccacgagcaatacctatgggatggataagtctatccaccctccctcgggccctggtaaggacgtggatgtgtcatactcttacaggggtagtgaaatagtgaggcccaacattaaatcacctacagcaagatacatcagcctctgtgtccccacgctggaatcatgtttcaccagcgggtttacctgagctgactcccctttgcaatggtgcctgcaggtttaggccaatgctgttccttgtggaagacagagaagcctcagttggcctctgactgttggcaagaacaacatattaagttggcacaaaacaaccagaagccccaggtggcccgtgcccagtgagataggagaggagcaggaagaactgtggaagctcagggaggctctcatccccagccccctccccactagtccccatctctgctttctttttcctgttttttttttttttttttctttgagacagggtctgactctgtcacccaggctggagtgcaatgttgtgatcttggcttactccaacctctgcatcccaggctcaagcagtcctcccacttcagcctcctcagtagctgggatgacaggcacatgccaccacacccagctaaatgttttgtttttgttttgtagagacggggttttgttgtgttgcccaggctggtctcgaactcctgagctcaagcaatctgcccacctctgcctcccaaaatgctgggattgcagacatgagtcactgagtccagcctgctttattttttttaacagtacttggaaccttctaatgtactaagtacacatgtattttcttttttttcctctcttccctagaataggagcttaacgtgggcgagtatttttgtttatctcatttatcaccctatccccagtggctggaatagcgtctggcacatgaatggtgtgttctaaataaatatttttaacaaataaatgaaatatcctacaagagaaagctagtatttggaactcacccatcaacagaaccaaaaagctgaagaccttcagcctgtccctacctctgaatgcacccagccccagcagattaaaaacaggaacaaagttggggaagggagcaggtggtgccaccccgaccaaggacccctgaggcttaggctgaatttgagctggagaagggactaacctaggaactgggcgtgagattaaagttgagacttgtctggcctggattttgtaacaccgaaacatgagctattccattcatttttgtttttgttttttttgagacagagtcttgctctgtctcccaggctggagtgcagtggcatgatctcagctcactgcagcctccgcctcccaggttcaagtgattctcctgcctcagcctcctgagtagctgggattacgggcacccatcactaggcccagctaatctttgtattttcagtagagacagggtttcaccatgttgaccatgctggtctcgaactcctgacctcaagtgatctgcccaccttggcctcccaaagtgctgggattacagacatgagccggcgcctggccatattccactcattattagcaagtctgctattataaatcaaggtgaccaaaatcctaggaaaacttccccagatgtcatcaaggagcagagaccagagacctatcagcaggatggggactagggcgaggcaggggagggaggcgctcatctctggattatcaggatgcagcaaatgaggcataaaatttaagggggcaccaaaaaattcacggatcaaaataaataatattttagtgcagaatttttttcaaaagttaaattcaatgcaaaaaaaaaaaaaaaaaaccctaatgggaaagttatcaacatttcaactaagacacaatttgaccctgtatttgcatgacttggcctcactcactcaccctaatctggcccctgcctcacagaagctgctggaatgcagcggctagagaacaatgaagctgttttctgctcctatccaattcagaccttccataaagcagctacaggtgaaatcgtgatgagccgcctatgccaacaggaccacaatctaccattaggaccacagtgaccgggtccatgttgcctgtccccagctgtgcccggacgctttggcttagaggctcaggccagtgctgcttctcccgttgacaccgggcactcatgaagagaaaacagacaaggccgggcacggtggctcatgcctgtaatcccagcagtttgggaggctgaggtgggcagatgacctgaggtcaggagttctagaccagcctggccaacatggtgaaacccccgtctctactaaaaatacaaaaatgagcaggcatggtggtgcccagctgaggcacaagaatcacttgaacccaggaggtagaggtcacaatatcgggcagctgcactccagcctgggtgagaaagtgagactctgtctcaaaaaaaaaaaaaaaaaaaaaagagaaaacagcctcggttataggaactcaggcctccacacagacacaatcaaggagcttagttatttaaaacgcagctccgtgtgggggtaggttggggaatgattcttattttctactttattctctttctctgttacttggcgtctctggccatgagcccgtcatttctgtaattagagcacagattgtggggaggggaaggacaggccgcctggcaatgtggtcctgtttttcctggaccagcctttgtgtgaggacctgtgcccagcgggcagattcgggtccctgaggaaagaggaggagccaggtagtgggacatttgaggtgacagcccttccccagctgtccaaggcccgcttggcaccgatggtcattcccagcatgttgggttggccttcgggggtctggtcaggactctcagggccatcagggtctggcaaaccctggtctgggtgtgaagacacctggggcatctagaccccctctctggccactcacacacccagtactgagaggccacagcacgtctgcccacgcctctgtccttgttcacttggtggctggccagtcatcgtggacactgaccgtagctcgagtgtggggtcctcaggtttctgctgggccagcaattgtgccccttgtgctgctgtatcttggggtgccagtacggggtctccatagggatagagacagcatctctgcaccaaccagtgggcacacagctgtgtttcagtacaaacacctgggccagctggacaacgcagcctgggctgagcagctctgatttgcctgaatcccagagttggcatggtggggtcattctttccagccaaaccagagagcacgtccttgggcaggatgaggagtgctcagagcaggtgaatggagctctgcagggaatgacatctcctccaagaagtgagggccctgaaatcaatccagggacactctctgagcatccccagggtacacaccaggcctcagggagcagggaaatgtcagccagcaaggacaggtctgtgctctgtggatgggccagaaagagggggtgcagcaaaggaatcatagtcgcagaggagaaaacggccagagtcacagcctgatttgtccctttctcactgggtgctgccaggagtccagtccaagccaacaacccccgagcacaggtatcaaaatggactgagaccctctaatcgcctcctggtgtcttgagatagcctcctacccactggcccccaacgcggagccctgcactggcttctccaagaagaaactggggggctgaggggctgacttgcggggacacctttcattcagtgcccgagaacctgttgaatgtttaacttatccttaaaaaacatgcctgcctctttgcatgtctaactctctgtaaggagcatgtgttactttgctaaagaaggaaaacatcactccagaccacctgtgcatttagcaaacaccaattcctagcccagagcagatttgctgcttcaaaaaagcaaaagctcaaaacccatgtggagacttcagaggccgcctggcccccagctcaccctttggaattcactgacaggtgtgtttgtggctctttcttcttggcgtctggtgtcaggaaagagaagacacagggacaccagttgggggtttaatcccatcagacccaatctttggttctctgtgccccttaccttatccccatcgagacgtcgctggagctgaatgaaccacgagctgctgccctgagcagggagttgaatccacccttgatcagatggttgaagctgcgcacaccctctagggccctgcatggagatggggagtcacacctcggttttatctcacagcaaggatgacccctcactgggcaccccagctcagacctcaagggaaacaggcccgaggaaagatgggtggaaggatggggcccctggtgggaggactcacagggtaagagaccccacccactcaagcgattcacactcagggtctttggggctctcagaggaaacattggttcacagtgaacacagttccagctattcagggtcacaattatctgcagcaggcacaaccacccactctcaaaagttgaattcagtaaggcagaaacttaagctcaagatggatttttattgaaaatgatttctgtaatcatgttttatttacctgtatttacagattaaagtttgaatatggcaccttaattccttatcaaagagaaagaatgcatatcttgtggtaatggggaccagcagctccatgaatcgaagttttctgtggcttgatctagttcagagtctgagtgatacatgtgccagcaaaagcctctggtaaacagggagcagcgttacagccagcagagcccaagtgcttgcggagctgatggagatttaagggagcaggttcgagctcctcctgaggcggagtgagaggaaggctctccccatctcctgagtgtcaggctggactcaaaggggagagaaaatattttaaataaacaaaacactgtcgtcgcaataaaatgtgacaattctcttccctttcctttttttcttttcttttctttttttttttttgacacaggttcttgttctgtcacccacccaggctggattacaggggcatgatcttgactcactgcagcctcaaccttccaggctcagatgatcctcctgcctcctcagtagctgggacctcaggcatgtgccacgtctgtttttttttttttttttttttttttttttttagacatgaggtctggccacgttgtccaggctgatctcaaactcctgggctcaagcaacctgcccacctctgcctcccaaagtgctgggattataggtgtcagccaccacacctggctcccttctctttctttttcacctgacagtgtctctgcatccccatctcttagcactctcctgacttcttagataccctggcctcatctctgatctgcctgatctctggccttagcacttgctgttcctcccacctagcacactgttccctcaaatcacccatggcagccccttcttatccttcaggactcagcccacatgtcacctcctcagagaggccttcccagaccacccaaaatgagacagtagctccacccccatgactctttatcccatctcccaatctgtgtcctttgttgtatttttcacagtctgaatgatgtttatgtgttgacctgcatgctgtccatcctcatagactggaacttcctgagagtgtcatgagatcagatggctcttactcaccgctgtgtcccagacaccagcacagcagcctgtgtttaaaggtggtccgtcaatgtttgttaagtgactggacagatacggaagtggacggttacactgacagtttttacagggggacgtgttgctttgcctttgacttgttccattgtcctcgtatgtaacgtgggcctgaccgggaagaggtggtgcctggacatgacgaaaaactttcacacgatctgtcggacaacaaaccacataagtatcccttctctatccgttattctataccttcatggataaatcactagacctcacgtgggcacaggaattttgaaatatatttttaaacaaattgctaatgtagacagcgatcctaaaatatagagagacatatagacattcacccgagccctgcacactctacacatgactttgcaatccatccttcgaggaagtctgcagtgaagacggcccttcagaactgcgaagaattgagtcaaggggctggacctttagacccctgtgtttactactagtctttggagatggagggaccccaggaagggtgactgggcaaagcagctcctgtcagccaggggcattttctggggagggtctcagctgtgagctctcagcaggcaaccccctgggcagtggggcatgcgtgcctgctcctgaaaggggatgtgggggacacatcccagcatctgctccaagccatgagtctttctcacccgggccattgtgcaaaagcttcccgacaggcctcccttcttccactcttgccctatttacctattttccacacagcagccagaggaagcctgtgaaacccaggtcaggtcctgtgcttcctctgctcagaactctccatggctcccgcgtactcagagtaaaacccggagcttcatgataaccatgaggcccgcagcttctgcctccaaggcttctctggcctcacctcccgctgctcctctcctcactcggccgcagctgtggctccctccccggttttccgggaacatgccagcacacctgttgctggctttgtactcactgtttttttgcctggaaggctccaccctcgatgtcatcctggcccgcagcctcagctcctccagtcttggctcaaatggtggcttctcagcagggtcttccctgaccatcctactgaaaatcaacaaccaccttccatagggggctgaacaagggccccccatatgtgtccacattaaaacccctgggccctgtgtgtatgtccattgcaaaggcgctttgctggtgtaaagtgaaggatcttgagatggaaagatgactctggatgacctgggtgggcccagtgtaatcacagggtctttataagaggagggcaggagggtctgagtcagaggagctgtagtgacagggcagagactggaatcatgtgcttgaggatggaggaaggagccacgctcccaggagtatgaggggctcaaaagaaaatacaggccagaccagcactttgggaggccgaggcgggtagatcacttgaggtcaggatttcaagaccagcctggccaacatggtgaaaccctgtgtctactaataatacaaaaaacattagctggacctggtggtgcgcatctgtagtctcagctacttgggaagccgaggcaggagaatcacttgaacccaggaggcagaggctgcagtgagccaagattgcaccactgcactctagcctgggtgacagagcgagactctgtctctaaaaaaaagaaagagacaaagacagagaggaaaaaaaaggaaggaaggaaggaaggggaagggaagggaagggaagggggaagtggaaggggaaggggaaggaagggaagggaaggagggagggagggagggagggaaggagagggaaggggagggagaaagagaaagagagggagagaagaaagaaggaaagaaagagaaagaaagaaagaggaggggaggggaggagaaggaagggaagggaaggagggaaggggaatgaaagggaggagaaagagaagggagaaaggaagggaggaaggaaagaaaggaaaggaagagaagggaagggagaaagaaagaaaaagaaagaaagaaaggaagaaaggaagaaacaaagaaaggaaggaaagaaggaaggaaatacagacactgaaaatgcaaagagtcctgccctcagggcatccagcaggagccagccctgttgacaccttgacttagcccagtgaaactgacggcagactcctgacctccagagctaggagagagtccatatgtgttgtgtgaagctatcaggttggtggtgattcgtcatagcaaccacaggaagctaacacaccctcccacatacctggagcttcctatccccaagcctgctgaatgtctccctgtagcatggattagcagctgacatgcatacctttcactgatttgtttatccctctccacttactgaatgtgtgctccataaaagcaggaattttgtttgttgcaagatcccctgcacctagcacagtgcctggcagatagcaggtgctcagcaaacatcctctgcaatgctgcacttgagtcctgaggagggagacggagcagatcctgggatgagccaggggacagagctccaggcagaggcagcaccaagggtagagtctgagtcacagccaatcccatccttctagatggctgctgtaggacccatggataaaattcctcctagccctgcctccacagagaagtcccttcaactgaagccatggaagctggaaactcacttaagagcccctacagtgagagattaagagcatagaccctgaagccaggctgcctaggttcaaatctcagctctgccactcactagctgagtgactctgggctaattaattaacctctctgtgcgaatttcctcgtctacagaataaggataatgatagtgcccatctcatagggctattgtgaggattgaaatagctaatgcatttagcacagtgcctggcacacagtacacatgatctactgttcctatttgggtggaaaagtccagcaagttgcaaagattgctaaaaagcaatgagaatataccagggtgtctaaactgacaagcaaagggtatgattaaaagacaagccaggttggcagcagaacatttgctttccttggcctgggccacagacaaggaattgaaaggtagcctggcaacgctttgagaaaaattaatcacccctgttgcctgcctgcccctgcccatcccatttaacctgcattcccccgccccctaccctacccctaaagggatcctggagcctcctgttgcacaggccgggctgtgacatccacaacacaccccagctgggcccagcaagttgttttccagccccatctgcccagacacagccctgtgaagagagggccgaatgcagagccagggctgtgttgactgcagaagggacggaagaaaatagatggggtgcggtctgcacagtgggaggttggtgtgtcatgtgggtctcacatgtggcttccctccaacaagccccctgcaatccccgccagacgtaaggagggaggggtgaaagtggggtttccgccagaggcagcagagctgaggaggggcccaggctgcagggacctgtgtacagggcatgagatgtcaccgggggcttcctacatgagatgcagtgagtcatcagggtgcagggtggaggctctgaaggaagagcccaggggaatacaggaaaaaggtgacctgagaatccatcagccaccaccccagtccttccctcctctgtccaggagcagggccagggcccaggagacagggtgagctttctgcaggagggacacccgccctgagaggaacctgggctgtcatagccgcacagacactgcaagccaggagcagtggccacacccgtagagcaggggtatcagaagggggcagaaacacaagcttgtcacctgagggctgggagcatctgtctttgtggtgaccaaggggagacaaagcaagtgacggagacgccttctcttcagcagtggttccctctgcaggtctccagggacagtgggtctgaggggcaggaatggtggggggctgtcatgggtgccgcattaggatgtccccttctaccctgagcagcaggcagtcccctcgaggattccacgtcatcagcctctggcccgagggcttcccagcgcctccctttctccgttttgggtgacttgggcaggcactggcgtctacatctgtgcactcttggcacctggtgggtgcgacctgggccctcccatcagacacacttcaatctcatcccacacagcccagggccagaccttggcacctcatgcagactcagactacgcacctgggatccgggcactgagactgcacgtggcctcttcccagtgtctcagagggaaatgaggctggaatttctcctgggacactggacaccccgcatctcatggtgctgcataagaggatgcttggccctgcatcctccctgcaataaccatcatttaatcaggccagaagaagtggagaaggcgcggcccatgggacagccatgtgttcaaaagcagcccccacccatgcacaagcagccctcagaggtgtccaggcagctccaaccagcagataacgggcacccagaatgtgcagagccagcccagattgcagcctggatctcaatttgcaagaaagaacttgccagcttgagcagctgccacgagtcccagcggcttggcagtttctcctggaggctgttcgcagagccagaccagggacggggtcttggccactatgggtccccgcagtctgcaccgagcttggagtcaccaggctgatttcacggatgtttatggagcctgcaggagaccatagcttagtgtgtcccctgctaattaaaggacaacagccagttgttccccgtcagagattacaaaggatgaatgctttggacccagggagcggatgggagcatatcagatgccaaaacctggtgcctgccacctggcattctttggaagtgaccctttgtggagcattggccattatcggggagatgggtattggggagcctccctctcagctctggggtctcaactctgcccacatagggcaggaggacgatgtcctgaagctgtgcctgtccttgcccaaggagggttgggggctttgcaggggggtatgtgaatgcctgcaggcctaggggtcaggggacccgtgcagggctggaagaggggttctcggccacaggacagccctgcttctgccagtgaagccatgtgtggaaatacggctcagcattgctcaaccttccagcagccaggacaccctgggtttgagtccctgctacagataaaagaaccgaatctgaccatttgtctccagccattctcagcctctgcctctctccccagcccctctaccaggtgttcaaggaaagcagagcccagaacctgtcgtgtagggccttgggctttccacggcctgatcagtgctagtctctggggagcactttgggggacacattcagattctctcgaatgcctcatacccggactgcaatcccccattccaccagcgatttcaggaccatgtgggaaatttcatcaaatttgcaagtgtgttgtttcttcttttacccccattctatctgtgagatgctctagaattcaccagatgtaatatatctttgggatgaatattctatgttaagtcctttgaaagcaatcaacaactgtaatccaattactattggctgtatctttctcttttgccccaaacctcatcctgtgtgccaagctcaccacacacacacacacacatacacctctcacaacagatgctaattttgtgcctcgctgcctcacataacgtgagagcgttgagtagtgaacagctgatctgcatgaattaacgtgggaggtcatgtgggccctgaagctttcacactcacaaaccagtagcaggatgggttgtcatggagatcacatggagggacaccagagttcccccaggactctgggcctcctctgatgagcaggtcacatggggatctggggggaggcacaggcacgaactgcatattaaatacacctgactcactgtgtctgtgagtgcgtgggcgtgtgtgggtgtgggagagtgcatataggagtgagcatgtgtgtgagtgtacatataagtgtgtctatgtgtgttagtgtgtgcatatgagtgtgtctgtgtgagtgtgtatgtatcagtgtgcatatatgcgtgggcattgtaggcacacatgtgcatatatgtatatgtatgagggtatctgtgtgtgagcaaatggatgcatgagtgtgtgtgggcatgtgtatctgtgtgtgcatatgtgtaagcgtgttagtttgcacgcatacgtgtccagagcccacatgggatgaaaactgaatggctctaaagatctactggacacatttcagatcctaacagagctcttaaagctccaaggggtcactgaatggacaatgagtgtttctgagtccaggtggcactgactcagcaatgcaggaaggcagctccttgagttccaggaatgacctgcaccccttttctctccctcccggtcacccacccctccccacgtcccttcctcttcctctgtttgccttccgtgcctctccctttcccagtctcatttcttgcatgttcatcacttctacttcctgcagttcaattcccctccacccctcagcatggactgtgggatgagagagccacagccttatccctgacgtaaccaaaactcttggcaccagcttagacctgtttttcagtcttataaacaggtctcaaatcagggaaatgtaaggttctgaggaaaatgatcaccaccaggtgattcccctctgtgttaccgtaaggcggtgagacagagattctctaacgtttttagtgcaacccaccgtaagaaacccactgcaaactgccacccagcacacacacaagcacatccatttatacagaaacgcagcacgtttccccaaacggcactcacccccgctgcacacaatgcgctctgatgtctcctgacctagtctatcctggtctattgcagattttcaatgcggggctcgacactctaaattgatttcaagacccactaatgcatcacagcctgcgatttgataaactccacgctaagacacatcctgtagtgaggtgttcgacccagaggccatttatcctgcagcgagtggggtgaggaggaggtggggaggcaggattaaccctgaggcacccctcctcctgctcctcccatgtatttttggtagagatgggttttctccatatcggtcaggctggtcttgaactcccaacctcaggtgatccacccacctcggcctcccaaagtgctgggattacaggtgtaagccactgcgcccggcccctcaataggtagtttttcagcctttcccccctcccttcttttcccctttagtaatccccagtgtccatcattgccatgtttatgtttatgtgtagccaatgtttagctcccacttataagtgagaacatgttgtatttggttttctgttgctatgttaaatcacttaggataatggcctccagctgcatccatgttgctgcaaaggacgtgatttccttctgtttcatggctgcatactattccatggtgtatatgtaccataacaaatgtctgtttcttttccctgagtctttttgggccccatgtagaaggatctgcaggaaagttaaccagcaacagtgtcaggattggggaagggcaaagctcacagggatcttggctggggggatgctcgggaagcccccaccttcagctgggcccagggctcaggctgaaagagaaaaatggagttgttcctggaaggcttggcagtggagaggacgagacattgctagatcactataagaaggtgataaatgcttgacccggctcaaagtgttttgtgccagggttatgttctgagatataggagggttaactaagctggggctgtggattagttatctattgctttgtaaataattacttccaaaacttagtaacttaaaacaacaaacttttattatttcatatgtttctgagggtcaggattctgggagcagctgagctcccagaatccgtcacgaggttgcaggcaagctgttggctggggctgcagtcttctaagacttgtaagagctcgaggcagatgggcctccaggataatttacgtggctactgggaggagtttttggtccctaaccacatgggcctctctaccacatggcttctgagagagaaagagagagagagaggatgaagatggaaacggctgcctttataacctaatattggaagtggcacatcatcacttctcccaaatgctcttggtcacccccaccaaatatggtaccacatggtgggggacagctgagttccagaaaggagggctcactggaggccagttaccagaggctgggtgtctctcactgattcaatcttttattcaaatactggcctggcgcagtggctcatgcctataatcccagtactttgggaggttgaggcacagggtggcaggggttggggggtataactaatccacagccccagcttagttaaccctcctatatctcagaacataaccctggcacaaaacatgctgagctgggtcaagcatttatcaccttcttacagcgatctagcgacgtcttgaggtcaggagtttgagaccagcctggccaacatggcgaacccccgtctctactaaaaacataaaactgagccaggcgtggtggtgcgcacatgtaatcccagctactcgggaggctgaggcaggagaatggcttgaacccaggaggcagaggttgcagtgagctgagatcgcgccactgaactccagcctgggtgacagagcaacactgtgtcaaaaacaaaaacaaaaacaaaacaaaaaaaacccaacaacagaaaaacaaaaagtatgtagtgagctcctgccacaagcagagcatcgctctggtctctcagaagtcaacaggaaaatagacaatgtccctgcctcatggagttcccactggaggagtgaaagagacagacaagatacacgtaaatgtctaatacctttcgttggctctaagatgtgcgttttcctgcatctttaacatctctaaaattgccatctatcttatgagttgatgctgtgtcatggcacatttgacggtgttttaaatcttcttctcttcagggtgggacaggaaaacctcatgaaaaagaagaactggggagagttaaggaagagactgttcagcgaccatgagcagtggagctgggttgcagggaccaaggtgggggtgctgcccctgggacaagccccagcctcccaaggcctgaaggggcaagaggaggaggtagtgtatcagaacctggttgaacgtgagccaggggaaggggctgcagaagctgcgggtgttgagaattgcagctactgccaacgccacagctgttgcctggcaccctggggcaactctctttactcccgtcctgtatcccctgccagagtgcctgtgggctgaagccagggaggctgggggaaggtacctagaaaccaggctcctggggcatcaagtaaggtgaataaggggtatggagagaaggtaaccagcttttgggataaaggcataaggagagagggatatcccaagaggactgctgggaaaggcctctctatgaagtctcagctaagacgcgggccatggaaatgtctggggagaatgtcccagagagggcaggacctgagtgggccgagcgtgggctgcaggaagctgaggagctggtgggcctgggtggagtgggcagtaggaagagaagtcagggatgaggtcaaaaattaggtagattctggaccacgtgcaggaccttgtgccatggtgaggagtgtggatttgactcaagcatgacagagccgctggggggttttgagcagagagaggacgtgatccaatgggtttaacaggagccctgtggctgtcatggaagaaatggccccataaagggtgagaaggaggcgggggcagtgaggaggctctggaatattccaggcgaaagatgagggtggcctggtggtccagggtgggatggtggaggtggggagaagcggtgggagtcaggactgattttgaaagtagagctggcaggattttctgatcagttggaagtgatgtgagggagaaaggagtcaagagcaaatccaaggtcacttcgcactgttcctatggagatgctccaaacatgggacttatgagctgtgatgaatttataattaagagtatgtcggcagatgcctcaagcttccaggccttctctagaatgttctcatgatcaaaaaacttgagcaagacccacactcatgatgttcacccctcaacccatgaagtgcgtgctgcaatagcccacatgtatcactggagtcctcctgtggccatgtatgtgctgggaggtgatcaagctgcttgctacaaacccaaagatgtcggcgttgggggaaatagggttgagacaggaagatggagcctataaggatgaatgagcccaagaaaggtgtctagcaccctgtctacagagggaggagggccttgtggttcctccagcccctggctgggtgaagtaacatcacccagaccctgctgtggtcggtcagttcaggaggaggcagggccacaggtgagcctgtccagaggagcaggtgccatgaggcccagagaagggaggtcaggaaggtctaccaggaggagctaacatgtgagctgggctgggctgggcagggtaggtgggagagagaggaaggaggtcccaggaggagacagcaggacaaggacatgcaaaggtacagccggcaaggccagagggaagtgatctgggacctgatccaggatgatgggactgtctagagcagcggtgcccaaattttggcagcagggaccactttcatggaggacaatttttccatggactgaggtgggggtggggatggtttcaggatgattcaagtgcattacattcattgtgctctttgtttctattattattacattgtaaaatataatgaaataattatgaaactcaccataatgcagaatcagcgggaactctacacttgttttcctgcaactaaacggtctcatctgggggtgatgggagacagtgacagatcatcaggcattagattgtcataaggagcacgcaacctagatccccctcatgcacagttcacaatagggttcgccctcctatgagaatccagtgctgcttctgatatgacaggaggcagagctcaggcgttcacctcctgctgtgcagcctggctcctaacagtccacaaattggtagtggtttgtggcctggtggctg[450 bp omitted]atttgcattataaatctcttctaatattaatttttaaaattcatatgtttcatatgctagttttatttttgtctaatgtccgagtactcttatactattaaaataagcagcacaggctgggtatggtggctcatgcctgtaattccagcactttggaaggccaaggcaggaggatcgcttgaggccaggagtttgagaccagcctgggcagtgaggccctatctccatttaaaaaaaaaaaaaaaaaagcagcattcatttgtgaaagaaccaaatcatctttggaggtatgtgtaccttgttttgggaaaccctgtatcataactaatgctcctttctatctggaggatgatgtagactgattatttgcagtcgcttttagcaaagaacacttgctgttcactggaatcatttgcagaagaataggggtggctctgccgggagagaagcatggggaccacccgtcctcactggctcagaactgaggggtttcctgggatatgggactattcgtgctaaaactggagagtttgaggcgatcctggatagttggtgaccatggagaggaagttggaggatcagagtccagcccacctggttttccagccctcactatgtggcagatatgaggatgcttccttggaccctgatacatgaatgaagggggcctgcatcaggaaagcgaggtcagtgtatgatgagtgctgtgggtgggcacctccacctggtcagcttctggggctgcaaaggctggaaagctgaaacctgcatttcccaggctcttggacgtggaggagttgaggcccccgcttcagtgagtgcctccagccgggggcacagtgggaagggttgggtcttctgcatcagggttccagggcatggccattcagtttgtgggtttgttccagggatttaggagctgagccggggaaaatctgaccatgaggtggcagtagcacacactcgcttcactgggcagtactttgacaggtttgcaagcagagaaggtccctcgcagcagaagccagggagggcaagggaagtctgggggcaggagcttgtgtgacgaagtgatgtcgttcagcagcgtagcccaaggagtctctggctcagggtgctcccaagggcagagatcatttgggggccctataatggcaaggctttctatctttaatgcatgagtaagagctgtcacgtgaggttttgcagggtaggcaaagcaggcaggctctaaatggctaaaaatctctttgggttatttaaaaaataatcaggtgtgtaaaaatttgagtttggcaccagtgggctttcgaggtaatggggctcagtttgctgtgaagaaagaaatgggccaggtgcagtggctcaagcctgtaatcccagtactttgggaggctgacgggggcacatcaccagaggtcaggagttcgagaccagcctggccaacatggtgaaaccctgactctactaaaaatacaaaaactagctgggtgtggtggcatgcgcctgtagtcccagctacttgggaggctgaggcaggaaaattgcttgaacctgggaggcagaggttgcagtgagccgagattacaccactgcactccggcctgggcaacagagtgagactctgtccaaaaaaaagaaagaaagaaaagagaaagagaaagagaaagaaagaaagaaagaaagaaagaaagaaagaaagaaagaaagaaagaaaaaagaaagaaagaaagaaaaaagaaagaaagaaggaaagaaagaaagaaagaaagaaagaaagaaagaaagaaagaaagaaaaaaagaaagaaagagacagcccaggggccaatcctcagaggttatatttggctcctctgtgtaacagtggggtgggggtgcattttggaggcagctgcttcttgacccctggtgtgttcttcaactcagcagttcctcctcatgctccccaaccccacagcccatttctctggagtgcctggctatgtggtttgtttacgtccctggcggatcagttccggggtcctattctgggtgtctcttctgaggacccagactgcagcctgtgcccctgcccttctcatgattttggggggatcctagtcccctgtattcaatccctttctgcctaacatggctaatgttgttcctggtatctggaactaaaccctcctgagacaaataatggctgacatccggtcttggtgccagggagacagcggccagcaccgggggctctggagggcttgggagggggtggcctccactcagctcctgccatgtagggttggccagtgtctagagtttcaatgaaagagattcttatgtaaaataatttgagtcttgaatgttggctcatttaacaaaaacaaacacaaaagagagagggccaaatgaaacatgtctgttggtgagggtgctcatctgcaagggccgttgtaacccagtaccctggactgggcgctttgacagcagaaacgtattgtcctgcagttctggaggccaggagtctgagatcaaggtggcagtggggttggttccttctgagaactgtgagggaatgctgtgttccaggcctgtcttcttggcttgtagatgggccatcttctccttccatctttcctctatgtgtgtttctgtgcccaaatttctttcttcttcttcttattttttttaatgaggacactggtcatgttctatgagggcctaccctaatcacctcattttacttttttttttgttggatttttttttttttgacaaagtctcactctgttgcccaggctagagtgcaatggcatgatctcggctcactgcaacctctgcctcccaggttcaagcggttctccaggctcggcctcccgagtagctgggattgcaggtgtgcaccaccacgcccagctaattttttgtatttttagtagagatggggtttcaccatgttggccaggccagtctcgaactcctgacctcacatgatctgtctgcctcggcctcccaaagtgctggcatttcaggtgcgagccatcatgcccggcccttattttactttgattacctctgcaaagaaggtcacattctgaggtactggaggttaggattccaagaaaggaattttgaaagggacacagttcaacccagggcagtgagacgtgtggaaagggccccaggtcacagctgctggaggatccagggctaatgagcagctaaaggaaagaaggactggagaagagcagatttccacaggcctgggcgccctcccgtttaggaagcctgccccagaagtccctttgtggcagctttgaaatgcacctttctggcccaggccaagggctgtgctattgtgatgatgcgtgaaccagaaaacacccattggtgtgcctgtaacacagctcacagacccgagaccgtcctctcctcccagaagtgagtcagcgagtttcaggatcagagcaactgggcaggtgacaggtcagcgatgtcccctctgcacagttcccagggtgtctggggcagattagctgggcagcgagatcacagagcaaccaggccataaattgctccaatgaggaggcaggacttttcctccctgcccttttcaaacttgctgtggtggattccttttttttagttcagggaagattgatgatttcattacttgtggcactcagcaacaaatctcagagttgcagctaaagtgagctctttcaccacgctgcatcttccgctctgctattcatcatgtttaatcattcgcttacctcggaccgctgccggcctcgggagggcagggtattacggacttgggacagttttacactttagaggctgaggggaggggactgtgttaggaaggaacagggctggggtgggaggttcatggctcaaggtgggcgggagccagtgaagcttcaacagaggcaacagaatgaccaataaagggaagtgacagcaaaaccctcctgggacctcaaaggctggccctgtttgccaagaaaatctctcataaaaggggtgagacttaacgccaaaaagaaaaggagagaaacggccggagggttctctgccaagggaatgttgaagaatttaattcgagatgaaatgtgctcttgtttgtgtacaattaattttctccccaaatgaaaggttttgtctgtcacttgagtgtttcaatagcaaccgcgtaattaaggtagcatgtgcctcttcagtttgggaagcggctgtttgtgttaacatgttggggaagcacacattgcttggactggttcctgggtctaagaaggtaaaaaacaaaacaaaacacacaaagaatggaagaaaacacctccaactagagccttggctcctgcggggatgatgtcatctggaaactgtgagcaggaccttccctgagaaccaagaggcctgggcttcctgggatgggaggctgtgaggaggagaacttagacagtttccagaaactctaaaaacggagtcatgaattcaaacgcccacgggggccaggtaggaggtgtatgtcctggaaggggttggctgtagtttttcaacacaagtgtgttttgtttgcgtagcaacacacaggtgtgaatactttagtgccacaaaggagtatgcactctcatttgtgttgaaatacatgggtctcctaatttaagtttcatgggttttttttttcctgttaataaagagatggtgtattacttctctactgctgtgtaacaaattgccacaaatttaggggtttgacacagcagccatgtcttatctcacaggttttccaacatgatgtggctggattctcctctgaggatctgaccaggctaacatcagggtatctgccaggctgtggttcttatctgggactcaggtcctctttcaagtttcctggttgttggtagaattcatttccttctcatgttttccatgtggtcctccctatgttcaagctagctatggtgggtggagtcctactcatgctttgaatctctctgccttcctttttagcttttaagggttcctgtaattatcttgagcccacctggataattgaggatcatcttcctatttgaaggtcagctgactatttaatcttaattacatctacagagtcacttttgttctgcagtataacatgataatgaaagtcacatctggtggtggaggttatggagaccaactcaatgttgagaagtgaaaaatctggttaaaaagagatgagagatctgaacagacattttaccaaagaagatatatgagtggcagctgagcatatgaaaagatgctcaatgtctttgttgatgcaaagtaaaatcaccatgtgatgccacgacacacccagtagaattgctaaattgagagagactgacaagaccaagtgttggcaaacatttggagcagacggaacactcctacatgattggtggttgttccaatggtatcaccactgtgtcaaaacagttcccagtttcttacaaagtgaaactcacactgtttgacccagtgatctcactcctcggtatttatccaaaagaaatgaaaacatatgtccacacatagcagctttattcatcatgaaacaacacaaatgcgcatcacccggtgaatgggtaaacacaccagtgtatgcagttacaatggaatatgatactactcaacagcaacgcaaaagaaatgatttaccgataaaagcagcaggaatggagttcaaaagtataatgcagccggtcccagtgtgctgtggctccacgtggcctgtagtcccaagtccgtgccccacattgcctgcctgccatggagcctgaccctaagggccctgctgcctccagcctcactgccatccccgaagtctcgttccaccagacgtgtagcctgtggtccgggcaggccttgtctctgctccacgaccagcactcgcactaccagaacatccttgtcttctgcagtaaaacctacagcaatatgctggtgttggatggcatcgtcctgggcatagggagggatgagttctcctgccaggagatggtagccatcctgcctctctgcagccaccccaagccacgaaaggtgctgatcatcgtgggcagagatgggtgtcttgcacaaggtggggaagcacctctccatggagtctgtggtccagtgtgacattgacaaggatgtcatccaagtctctaagaagttcctgctaggcatggccagttgctactctagttcaaagctgatccttcatgtgggtgacagttttgagttcatgaagcagaaccaggatgcctttgatgtatcactgacttctcagaccacatgggcccggctgaaagcctcttcaaggaagcctattgtcagcagatgaaggtgaaggtggccctcgcggaggacagcattctctgctgccagggagagcaccagtggctgcaccttcacctcataaggagatgtggcagttctgccagtagccgtggtgggctacacctactgcatggtccccatctacccctgcagccagactggcttcatgctgtgcggcagaacatgatcacccgtgaccgggagctggtgcagcacctgacacagcagcaggtggggcagatgcagctgaaatgccacagcccagacacacaccgcacagcctttgtgctgcccaggtttgcctgcaaggccctgaatggtgtgagctgagccccactgccaccaccaacaccacctgggacctcggacaagggagtctccagggtgcctgggtgcctccagccctgggccagacctcctgccggctctcactgatcaaccgagtgttacaggccccagaatgctgcccggcctgccctgctgggtggactgtctgtctgtgtgtctgtgttgctctgtgtggcattcagcctccaagcctataccagctgtgcacaccgctgtctctctcacttctgttaccctcctcactcaccaaacacatgtattaacaacaacaaaatagtatgtttaggaagaagccaggcacaatgcggttccatttgcatgcaattctagaaaattcaaaacaaaagtgacaaagagtagtggttgccaggggctgatagtggagagaagagattgactgccaaggggtgggagaaaacttttttgggatgagggaacattctggattacgattgttatggtggttatttatatgactgcatacaattgtcaaaactcaacaaaatgttcacttaaaattggtggcttttattatatgcaaattataccctcatagagctgacattatatcattactataatggaaaaatcagtgctccctgccaaaatttcaggcagctgtaaaaagaaatacacatatgtggctgggtgcggtggctcactcctgcaatcccagcactttgggaggccgaggtgggtggatcgctttgagctcaggagttagaagctagcctgggcaacatgtcaaaaccccatctctacaaaaaatacaaaaatcagccaggcatagtggcttgcgcctgtcattgcagctgcttgggaggctaaggctggaggatcgcttgagcctgggaagcagaggttgaagtgagctgagattgtgccactgcactccagcctggtgacagagtgagaccctgtcacacacacacacacgaaatacatatacgtaaaaagtatatgaaaagtatataaaaagaaaacagacatcccgggtgttgtgtgtgcctccttgcaccccccaaacccatactatggcttactaggcactagattccagctatgggttacatctggagagccccctattgcccccaatagatgaccacagctgtatagattgtgactatgaagatatttgtatgcattgtagaatcagcttaatatgtgaaatggtagatgttattcaagggtgctagtctaaacccacaactggaggtttgttcagtgagaagtgattgtacacacggtctgtcaaataggaccacactttgcgcctccaggactttgcacatactgttccctctgctgggattgctcttcctgcagctctttgaccagccggtttcttctctttcttgggattttggcatcaaaatagtctcagaaaagccctcactgaccaccagccgtgctaatgcagcccccaccccaattactctctgactcaaagccatgctcatttttttcaaagtcttttcctaactagcttgtttattgatttaactgtttttttttttttcagagacagggtctcactctgtttcccaggctggagtacagtggtgtgatcatagctcattgcaaccctgaactcctggccttaataaagggatcctctcacctcagcctcctgagtagttagaactacacacatggtttttttttaatctaaaattttttgaaatttattttttgtagagatgggggtcttgctatgttgcccagactggcctggaactgctggcctcaaacaaccttcctgccttgatttctcaaagcactgggattacaggtgtgagccaccatgtctagccactgatttaaattcttgagtgtagattttctttccaaccagaccatgagccccatgaggttaaagccaggtctggaccatcccatgcagtttctccacagccttgagtgggggcagtcacaaagcagactggattagttttccattgcaatgtaataaattgccataaacttggcagcttaaaacaatgtgcttttatgatctcacagtttctgcagatgagaagtctgggcatggcttagtcaggccctctgatcaaggtctccaaggcggcaatcagagtgctggctggggctggggtctcatttgaggcttggctcctctcccatgctcctgtggtgttggaagaattcatttccttatagctatagaactcacagcagcttgcttcttcaaggacagtgggagagcatgtctctggcttcaaatctcttccttcaaaaagcctgatattctcttttaaagagctcacttgattaggtcaggctcaactgagataatctctctttggatgaattcagggtcaactgattagggaccttaatcacatctgcaacataacataatctaatcacaggagtgaaatcccatcctatcagcaagtcccacctacatgcaaagagagggtgttataccgggtgtgttcgctgcggggtggaaatcttgcaggccatctagaaaattctgcctacaacactggctctcaatacatttgttgaatggataaaacacctgcccttccaaatgccttcctttgtttaagattatttcctttgccaggagttctttccatcttgctgccgactttgcttgtcaaaatcttgtttatcctctggctcagattcccttctcattcctgacttcctcactgtttcaggcagacaaaggttaggatttaccttcctcactacacatgtgaggccagatggtttcttagttgtaacgttcttatgtagagacacacatgtacatttacgtaaaagggatcacatgactcctgttggagtgtggacacttttttcttctctacctttcccctcacatctgtccctccatctccaaatataacttgtattttaaaaaaaacaggatatccttccatgttttcctttgtattcctataaccccataaccctgcaaagctcatttctttctctagaactcctttctctttctctttctttctcacacacacacatacaaaggtataaaaggaactttttttaagggaggatgagtcattgttttgaaaaaatggtattgtatgacatacatttttctgcatcttgattttctcactcaatatcttgtaggaatatcttcaagtcatcttgtatagttccaaattaaagttagttccttacaacagatgtgcattatgtcacgaagtgaatatactcacaaagtgctcagccattcccctggaaatgggaatttgtttgcttctggttctgcaccactatgaacaacgttgcagtaagtatctttgtacattttggtacaaataggatggattttcaacggttcaagagctgggtgcatacacagggtatatgcacttttaacaattttactaaatgctgccagattgccttcagaagagattgtatattccatgtttctactagactgtaggaaagtatatcttccccacagcccagctgcaataggatttatggcacttttaaatttttgccagtacgctaggcataaagccataactcagggttgaatatgaaatttcttgaatactgaggaattcaaacatcttttattttcctttactttctttcttttttctttttttttttcctttttcttccttcctctctccttccctcccatctttccttaattttcttttttaaatattgagatttgctcttctgggaatggtctctttataacctttgcctctttctggttagtttgtaagagctctctgtatataatagaaattaaccctttatcatttgccttacaataattttgcagatttatagtgtatatgtatattttatttacataatcttgcaatgtacaaaattttaatattcaaatatgcttttttttcttttattgcttcaggatttccattcttggtttgtaagatatccctaacctttagattatatctgtagtatcttagattttcttgcaaaattttaatttaacttcgtacaatgaagtcttcgtcttgttagaatttaactttgtagaagacatgagacagggatgcattttagttttagccttaattttctggcaaataggaaaccagttgttctggcatcatttgctaaacaagtcatccttttcctgttcgaatgaattgctgtcttaagttacctggtggtttcttgggagctcagccagcatcgtgaatgttgggtataagttttgttttctctctaaccagcttgagtgaacagagcatcctggggtgcctctgtttaatttgtttactcattcatttaacattagttgtcatctattatgttccaggctgaaaaacatgcccattctatgtcctcaaggcctttttggttgaatacgagatataagaaaagtacaggaggtctttgtcaaccaagaaaaatagtcccttaaagtcaatttacttaagacagggacaccatatttcaaaataaagagtggaaagagtgattgagtctttatcttgagtagtgaaatgaaaagttttagagaaagtgtattttcttatctcaacaaaattgatgccataattgcaatgaaggaggcattgatttgggggtatcattttcctataaatcccctgcacttcacgtttaacgttcacagttctataaaagaaattcagttttgcaaaatatttcatagctcattcatttccacaaaggactcaattcttttgtatgcaaataattctctttttaagtacccatcaggtagtgtgtcgttaactggtctaattaccatgtcttcatgtgcccatggcttcatgagctgttctcactaatttcactttcatgaagttcacgaaatcccatagtctttgcaagatttgcatttccattcggcactggttttcatctacttgcatgatgtgcacagatgttttcacgtcaccctcaggaaacctggcctctgaggacctgttggggttggcacaggggagaaaagtgcaaagtgcagctgagactgaagaggtggattttggagatgaatgttgtaatcggccagttcattagtgaactcttggactgtgatggctttatctctctatgcaactttgtaataactatggggactccattcataaagatttggaccatgtgaacgcctttatacaaaaaactgtgatctacaaaataggagagaaatattgctggaacactctgggagttctgagagggaagtggctacggctgggtgagaggctcatggggaacaggtgacggggtttgcaggagtggcaggagcccgctaagtggttcctgaaggatgagttgggttggcagagggcattctagctaaagggaacagcatgaccagatgcagagaggaagacacgaagagcaacatacgggtctcccttcaaggaaggatttgctgctgggctgtggcaacatgtggtcagcagacggtctccagctggcagctggaaccacctctaccataatcaatgtctccccgtgcctggcctgtctcccacttcctttcacaaatgttgatccctaaaaacaacttccactgaaaactccgtctcagtttctgcttctggagaccccagcccgaggcaagagcaatgggttggtgtgggggctgcagtgggatccacgtggttcagctccaacagcaggagttccccacctggttccaggttttcaccatcaagtccatgcattcctcagatcgaggggttccacggttgacgaaaagtatcatgtgtcatgttttggggattttgatgagatttgcctgtgacatcaggagtagccttttatttttatttttaaatgcttatttctgtgcccagcccagacctttacttgatgtccaggttcatgcaatcagctgtggttgggctgtctccaactcaaatagtcgtgggtttccctggccgccttctccctgcatcccccacctccatgatggcccttcttcctgcccaggtgctcaggccggcatggccagctcctctcctcccctggcacccaccctctgaccgctcagcacctctgtccatctgctgtccacatggaccaattcccgaactccggcctcctgtcttctcccgctgcagtccctgcctggctgctctcggaggatgatcacaccgcggccctccctggtctccctgctcagcctccacctcagtctattctttttttttttttttttaacttcttaaatgcacaaatttattttttctcaacaaacacacatcttaatgcctttacaacttttatctccccaaatatatcttgcttttctttatacatgctgtatacagagttgttttccttatatttagtagttattgcttttttgtgcccttttgggtcctgaatttacacatcaggcatagagcttgggacaggaaagagctgtgaagcaattcctggaagatcaaaccccttccagcatggccaggtagcacagctgagccagggatgatggggccatattgggtttggctctgccttgcagctggcagtccaaacacacctcagtctattctattcaacgattcagatcagccaggccagcaccgagcccgggtctccagcctcgctctgtgcagccacagcctttccccggtcgacagggccctgagcctctggcaccttccacctgccggtctctttcctgcttctctcccatgtggccttgctctgttcaagccaggagctccccacctcggggtcttaccctctgccccatccgtcctgggatgctcctttctgggatgtccacccactgtgccctcactgcctgggcacctgctgctgagactgcagaggtggattttggcccccttctccgggggctcctctgatgtccatgagcaatcacagcccccaccgccaccccctcccttcccagggctgtctttctccagcgcacttcccaccatctgacatagtttgcgtgtcgcacaccttaggttggattctgtgcagcagaacctgagcacccatgtgtgggagcccgtgcaaccctcgacacagcagcaggtggggcagatgcagcctcagatgcgcaccgcggggccttggtgcctttgagactgggcgtgactcagttcatctggagaagtccccgggaagagagggcaggaccgcggggagggagacgggaaggaaaaaacgcccatcctgatgggataaggagcaggtgcccacggtgggccactggtgctcagctgtgctggggacctcagggagacgctgaggagcggcctcagaggggtgcactggagaggcggggaggccagatctgctcccctgcagcttccattcgcccagggcagctttccaggactccactcccaggtcacacaggctcctgcagcccgaggaggccccgcaggagagcaggggcagcaagaagccatggtagggcaaagacggtgaggcttgcgggacccacgcggcaccaccagcttctgctttgtgcactgtcttgggctgtcacctgcttatcctctgggtcatgagctccctgaagacaggggtctgttttgttctttgctgtggccagagactacaactgtgcctggagcacagtcggccttgcttaaatatgcgctgagtgagtgacgcctcctgggtccgcctctgcaggcttctgagatggatatttggcatctttaaagaacccagatcccaggcaaagtcgcccctgatttggctgatgcagactccatctcctgctgcttctgggctgactccgaagcctgttgctactgtttgcagccaagttagtgttcccaacagcggcagctccagagagggactcagaccgctgataaaagctcccattacaccgggtgtttttctgatgcttttgtacagctaccctttgatgctgcagtcatgaatcctgacggcagagtgacgataatggtccctattacccctggcatctcacttgataggatgaccaagagcccacaaatcgctcctgagtgtacctctagcgacacatttttttttttttttgaaacggttccacctggtttgttcaggagaagaaacaacagatacgtgtattttcatttcttcctttagtggaggtgtcacaattgttttggaagttgtccaagtgcccaagaccccggtcacagactcgaccatcttccccatccttgaaagcaaagcatccatctccacatctccagcaccagcacagggcctggcaggagatagggctcaaagcaaagcgtgtctatgggccacccgagtgaggttagatgggagcccggaccgctggcctgcaggagggcccgaagtctgcgtgagtctccttctttccctgggggaggttcagccccaacaccgtggccaggattgctgcagaaggagcctccgcctggctcatcgcagccaggcgatgatgtctcgtgctgagtttgagttgggtgcttggttaaggtgctggccatcagagttctctgttgtaaaggatccctttccctttgaaattgccaaataacatgtgtggtgatattttgggaccttgtggacaccctgtttgtcaaaatcttcccccagtggttttgcatccactgatggtctacgtacaatgattacattgaaggttgcaaatggtcttgtacatttaccagcaggccttcctccaggaagaactgtccgttctctcagtcactattttcagtatggttatggactcagggattcttttttactccatgcattcacagccaccaccgaaattgttttatgttcttacgttcctacatctggccagtgggagccctattcttccagcttctattttgtggtttgttctgattgccccctttgaggactttctgattttctggtacaagatgaaatcttaacaacacgtcaatatcatgagaaacaaacgaggagggtgcactgttctaggagatgggtcatgacaaccaaagaccatgcatgaccatccatgggatcccagaatgaggaaaaaaagctcgaaatttggacttataagccagggatattcaatcttttggcttccctgggccacactggaagaagaagaatcgtcttgggccacacataaaatacactaacactaacaatagctgatgagttttaaaaaattgccagaaaaaaaatctcataatgttttaagaaaaaaaattgtgttgggctacattcaaagccattctgggccacatgtggcctgcgggccatgggctggacaagcttggtataagctatatttctgcatcaatattacattattggaggtgaaaatggtttggacactttgtagatctatttttttttttttttttgagacagagtcttgctctgtcgcccaggctggagtgcagtggcacgatctcggctcattgcaagtcctgcctcccaggttcacgccattctcctgcctcagcctccaaagtagctgggactacaggtgcttgcaaccacgtcctgctaattttttgtatttttagtagagacagggtttcaccatgttagccaggatggtctcaatctcctgacctcgtgatctgcccgcctctgcttcccccaggttcaagcgattctcctgcctcaggctcctgagtagctgggattacaggggtgcgccaccacgccccggctaattttatgtatttttagtagagacgcggtttcgccatgttggccaggctggtcccgaactcctgacctcaggtgatccaccgtcctcggcctcccaaagtgctagtattacaggcaggagccaccacgcccggccaaaatttttctatagctttaacatttttccaaatagtaagttggagaaaataaaaataaaatcaaataaatcagacaagaaacacgtattgaggttggaggcaaacctttggccctttgactgctctgtaaatatatctcctatcactgctgcctgtgtgtgccattgaaagcagacactttttttttttctgactaaaggataaatgtggacagactgaaaagcaattgtctctctgtcattcaggagaaggataataaggcaaagaggagggaggaaggaaaggagggaaagaaaaaaagaagcaaatgtggaaggcagaatggaaggaagggatttattgattagcatgtctgaaccaggcactgtgttaggtacttgcttttacgttattcatctccttccaatggcaacctttaagaggcaagaaaatcagggcttagagaagccgcaaacctgtcccttggccacaaaataaacactgggcatctcagataatgatgttcagcaaagaaatatgattaagctaattagccataaggtgatattggtggaaagcttcctggacatagagatttaaaaaatccttggctgggcatggcggctcatgcctataatcccagcactttgggaggcctaggcttgagcccaggagttcgagaccagcctgggcaacatagtgagaccctgtctctacagaaaataagaaaattagctgggtgtggtggtgtgcacctgtagtcccagctacttgggaggctgaggtgttaggatcacttgagcccagaaggtagaggctgcaatgagctatgattgtgccacagtactccagcctgggtgacttagtgagaccctatctcaaaataaaaataaaagcaaaaaataaaaaaccctgaccaaggtttatctgtttgtaaaaggaagctttgtagcaggaagggttgtgtcccttgagctgaaacatgagtagggacagcctggccctctcacctaagttgaaccttggcccattggacaggccttggaaagcaggtgctgtctcctttgcttcttacacagtctgtgggacatgaccctggcaggaccctaccccatcagggtgctccactccttgcttcacagtgaggagtggaggcccttgggggacttggtggctggggtgagccctgagtggagggtggggctgatctgggcacagcctccccacccctggccagccctttacagggttcagagcaccatgggcataaactcaggggcttcctctgcaatttgaagatgctcccgagaaataatcttaggcacaggaaggctttgccctgtgctcttacaatggagtcagcggctgggtgtggaaattagggtgagagggtgggaatatattgccccttccccagccccagccacccatgacaccggcagctctgggagggaaggacacttttgcaaacttaaacagcactgacaaggactctttctgattgctctccagtgagacatgagtaaattagctaattaaggcagctccactgaatacattctacatgcaggcaatttgctgtttatttcccacatggacaaagaaacgaaaataggaactaaatcaacatctcagaaagaaaaaatacctttgatgaatgaattataatgaaagatttcttgattattgaaagtgtgtgaaatggttctcaccccaaggtcaaaaatttaatagcccccgtccaaaccaaagtgtccatcattcgttcaggaaagtatttgtttagtgcctgcaacgtgccaagcctgtggctgggcctgatgatgaaatggtggggaaggcagagcaaaggaggatattaatcaaatagtcaaacagatgagacagatcagagcccttctgtccacatttcctggggtctggcatctcttgagattctggtaacaacaggccaggaaggaggcagacgctgtttgtgcaaagaagacagagtcggtagatgggacttgctggcagttgaagcctcacaaggctctgatatgtttcagacgctcttttttgaggccacgtcatcctgcggggtcctgtcctcccccagctctcaccctcctgggcagttctggaccagacaggaatgactgactgtcacgccacagtgggggcagaagagataaggtctggggcggagtggacagtccagggagttgaggagtgtcagtggaggagaggagaaagtgagggggtgaatggagaaaagggtggggccagcttcctgccggccgagggggggtcttgtggttctccctgacagcttgggatggaggtgcattcccatggataagcttgggaggcaagtggccagagaactcctatcccaccccgttcctgtgtcacagggaggatgccacatgggttgcgatgtgcctgaatccgggtgaagtactggctgttcactgtttcttctttgtgtgtccctggatggcaaaggagaggcctattttattgcaaactgttgcactcctctcctctctgatgagtgcattcagccagagtgtgcgttctcacatgtctgagatccctgaactacttggtgaccaaccactcccaagaaaattgctctagttcttaggacagtccttggacacattgagcattcagtaaacatctgtggacccactgaatgcgtgtcttaggactcaggcaggggccctgtcaggggatggtgctgttggcttcctgctcagaagctaagcagtgttgggcctcgctggtacttggatgggagaccgcctgggatggtgctgaggagcaggagtggtgtcagcataggggctttgggattcagtgtcccctttgagggaagcaggtgaagaggagacagctggggcctggatattggagtccctgggtaaggtgcccccaaatttggtaaatttgataacaagtgcctcatctcaaagtgagggccatgggtgggtgtgactgcagtgggtgctggttaaaaaaaatgtaaaaagctcttctggaaaaaagaccccaacaaccctgatttgtagcaattgccagtttccctggtgtaaatattcccaccatggctgatttcaagctaccaaagatgtaaccacaaattagcaaagtttctgaacatttcacagttggctctcagagccagctgcctgcactccactgggtgtgagggactgtctggtccctactaggggtctcacagtggatgtggggtgggtgcaccatggggctgtgggtgagcctgtatatcctgccatgcaacgggaagcattacttgaatcacccacaaagtccagcagtgaggacctggcagatgtagaccaataaacactgaagaagtggaaccagcagggatgaggatgaagcaggatctcccaaagggaacacagaccatgtcaggaggaggagagacccctgtggaggctctgaagcccctaacggtttttgaaaatgtctcctttgatcaggctgcaaaactcaaacctggggggaaagaggttgactgtcgctacaattttattagaagaattatgttgaaaaatgagaacttgattcattctttgattaagaattagggcacaggctgggcgtggtggctcaggcctgtaatctcagcactttgggaggccaaggtgggcggaacatgaggtcaagaaatggagaccatcctggccaacatggtgaaaccccgtctctactaaaaatacaaaaattagctgggcgtggtggtgtgcacctgtagtcccagctacttgggaagctgaggcagaagaatcacttgaacccaggaggtggaggttgcagtgagccaagatcgcgccactgcactccagcctggcgacagagtgagactttgtcttaaaacaaaacataacaaaaaaacaaaacaagaattagggcacgtttgccactataacctaaatgttgttgaataggagagaaaaactcattttcgccaatttaatttcatattttttgataaagctgtagttaagcttttctcttttctttttttcttttttttttttttcagaagaggtggtgagtgtgtggctgacagcaggggctctggtgcagggtgacctgatccagtcctgatgatgccaatttctacacaagcaaccacctttctgtgcctctgtgttttcatctgcaaaatggggacggtgaggtagtagtgcctgtgttttggagagtatatgatttaatacacatggagtacggggaacagcgcctggcctaaagtgagtccaaggtaaatgtttgttaactaaatcacaaagcatttgttgtgaaactttggtactcaatttaattgaatttaccttgaatgggctttttagttgtacgggttgtcctcagataacaacggccttgtttcattacacgtggtcctggctgggaagaaaagacaccacagtttgataagaggggccttgggggacctgacctgggccctgggcctgggcgaggaggtgatgaggacacaggagaatccccccaaggaggtgacattcatctgagatgtgacaggtgacgaggctcctggaggtaactgggtgaggatggggttgggggtgggggcacattctaggaggaggggccagcacgtgccaagaccttgaggttccgggaagcctggtctgtccaagaccagcggagaggccagtgtggccatgaccgagtggacacaggggtgagtggtgggaggtgggactggacgggggcagggacctgtgggggtttggtccaagggcagcctctgaggtttgatgggtccgatctttctctttggacgtccccatgggagggcctccttgtctaaggctgatcttttcctccccattcccaccatggcctgtttcacaggtaagaacccgggtgggaggggagacctctgtttcagggccttggccacatctcaggagaaaatctgtgaagactgattttcaggaaatgcttggctgggaactctgccatgggaagcaggggtctgagagccaggtcagcgatgctgtcttgtactcgtgactgaactggaggccgggcagccaggagaagccccaggaccctcctgattcatgcgggcctatgcaggaactgccaggggtcagaatgaaggcatctggcttcgggagcatccagtgggaagcagcccaggctgggaagtgcagattttaccggagctgtaggttttcatgaggaacctgggggtcactcaggcatctccctgcaaacagctgcctgcccacggtgaacatccaggggtcaggtcccagggcttctcctggcttccctgcctccagttcagtcccaagaacaagatggtgtcactgaccttgctctcagacacccgcttcccacagcagagttcccggcctgcctgcaaagtgctaaccacactgttggaattcctcaggggtgagcacgagcctctccgtttcatctgtgcctatcgtggacacattaactatttcatgaagtaacacaagtagcatctggagtaaaaaaattaactaaaaataggtgaaacagtgaaattcagtgacaaggatgctcatgaataattaagaggccgacacaggaccacgttttaaggagattctcattcctaagcctgttgcttttccctgcacagcacaagcaagacctgatttcccagcaggaaggttgtcttaattaaatcttatttgtcaagaaggcaagatgtatttgtgtttcctcaggctcccattattataaacttcgcaatgttttctctgagaaatgctccttttctgctcaaaagagctgattgttgctgtttttctctcttccattgtgagaaggaaatgctacaagttctttgtcaggtaatcaattatcctccttaaaggatccctgaagtgtcatttgaaaattatggctcctgaaaaataataaaatggccactttaacatattgttgcctgtcagagtgagtttctctcccctgcagagtcacagagcctgtaaattgcccgtggtaatgacctctggctccaaatgcagtcactggtctctgcacagatagacactgtctgtcacttctggggtttcactgttgacgctgtgtctcttttagcttctaggaagccctgtaatgatgctgtaattagcaatgcatccttccctctctcccaactccaattgctgtaatttatgtctctcaacaatacttacaccaagcacgccatctgtaccactgtgtggggaaggaagttctcaggttcaaggtctcagggagataaacacaattttaagttcacagacatcctcagcaatcaacatcaactaccacaccaagaaagcaagaccttggtattgttggcgagtagcaggtaattgatgatcttgtcagcatgatctactgtccctgatctgtatcaatatgaaataagaaaccatttaagaggtgtcaggaaaacatgtcaggcccccctcctcctcctcctaccatttgacattgactcattcacatataaaattgagtctttgtgatggtgaagtgttaaagaccccgtgtagtcaaattactatcatgaaaccagtgagtggaaacaagttattaaatgtccctggttcctcctcattcaaacaggtggaagaaaacaaacagaaagcttagatgcaaatgtgacttcatgcccaagtgttcgtgagaaccaatatacgccaagaaagagaaagccgggtggtgccccagataattcgggtgaaaaagacttctaccagaaaatcaaagacatccaggcacagcttgaggatgcagccgtagtccatccatcgtgtcttcttgtgaatgagcctcaagtttcttagcaacacaggacacgctaagtgtccctgtgacattcagtggaaatgttgaagcatcactgaaattccttgagccaaggtgcacctgttcaggtctcaagaccttttctgagagctgggcagaccaccttccctcactgggcttcagcttccttatttaaaactacacattcctttggacattccttgtttctgcccaatgcaagataaaggagaggtggcagaaaagttgaacttgtttctgctggtgttcccggaagaaaaatcttgatctcagggcatcctgaggtgtgtccttgggagaatggatccttgatgttatgaatgaattgtgtaggaatcgcaccctctaatggaaagtcgaactttcagactcgccaaaaatccaaaaagagggttctgaagtgtatgtggaatcttcatgtgtctttttgcaaggacattactcattcattcccaaggcattgggccgttccactgtaattcacagttagttggttaattgctggtgtagaccccaacatttagatatcctacttccttgcaagcagagccctggttttgctcagatgctgggaagcaatgtgctctctgacaccagggagtggattaccattggtctgagcccagcatggcagtctcacttacttttagtaattggcttggaggggacattgagtcagggctagtcaatgagatgtaatttgggagtctattggtgggggcttctggggtctctaaggggatctgtgaggagcaactctctcttttctctcttctttattctggtcatggttctgagtggatgtcttggcaggtgagatggcagccatcttgtctctatgagggcacaaggcagaggagaaggctggcacacagaggaagggagagcagagccagggggcatcagcagcaagtggctgaggtgaccagcaggggacttgcctacgtgtggctctcagacctttccttattgctgcaagcatttccctctgagaaggaccagctctacccacactctaccactccatctgcaagcccagaggtgcccaggagtcccttggcctccatatgaagctaccccttccctggcccacacctcagctgacaggggctgataggaagctccacaatgctgcgtgagcctggaaagatccccaccttcctgctcctaaagacacaccttccccaccacattccaccctgagagcatggaattaatcaccggataccttctattcctgttgaagtccatctcctcgtgaagcccgcctcctgggtcatcctttgtcccctggactctcagccctacatgacccagtgggaaatgaggcctgagccctatttctctggcccttcctgccctgtttctgtgtcagtttcctttgtagcattgtcattgtctgactcagtctttcctggggatcctggagacaatcatcttagcccaggtctcctcacccagagccaaggccaactgaaagagtcagtgcctttggggcgcagtgccttcggggcagatgcagccccaggggtccagggtggggaaacgggaagcgaggtggggaggctgggaagtgatgactgagctgatgacagcctcccaaagacccagctggtcaccaggtcacgtggagcatttccagacaagctgtgcagaaacgctccccacaggatggcccatatggggatggttgggaggggccatttatagctaatctctcttttttcctctcccttgagggtgcaggtttgctcttcagggagtcgtctctttcttttcttttcttttcttttttttcttgttgagactgagtcttgctctgtcatccaggctggagtgcagtggcatgatctcagctcactgcaacctccacctccagggttcaaatgattctcctgcctcagactcccgagtagctgggattacaggtgcctaccaccatgcctgactaatttttgtatttttagtagagacggggtttcaccatgttgggccaggctggtcttgaactcctgacttcaagtgatccacttgcctcggcctcccagagtgctgggattacaggcatgagccaccacacctggccgagtcttctctttcttaacaccagggtgcatcacccagtcccttggcagctgctggggaatccagatcccacgctcatttttgtggcaacttagctgaatccagaattggtggaggatccagaatcttggggcgtcggtctcaggccgtgtgtggtgtaaggcctgaaactgaagtgtaatattaagtacggccttgatgtctttgagcttcacagggctgcagaggccaaactactagttcccttccctcaccaatatgctcccagctcagtgggaaagactcccacctggtaggtttacctgtcaactggagcagccacgctccacctggtcctcagcttaactggcttcacctctctgcccacaggaaccaggggtacctcaccccgttgttacttcaaggtctgcctcccacagcccctcctgttctctctgttcccaggtgcacaccctgtggctctgcagggcgcgtgttatcctcccctgcgggctgtatttgtggccgacccactgcccgtctcatgtgtgcagcgctgggtgttgtgtgctcggccatctcatactatttagggcgaggatgcatccctcaccgatggggtgaacgggaggtagtcggaacacagtggtgtcctgtggacctgcgctgagtcagttcctgcagtggaagctggggaaaccagaggtgacacgctgcatgggtctgatacacagcccggagagtttgcatctcatttgcttgacagtttttctctagtggaaaatatacttatttttttttctttttcttttcttttctttttttttttttttgagatggagtctcactctgttgcccaggctggagtgcagtgtcacgatcttcgctcactgcaagctccgcctcctgggttcacaccattctcctgcctcagcctcccgagtagctgggactacaggtgcccaccaccacgcctggctaattttttgtatttttagtagagacggggtttcactgtgttagccagagtggtctcaatctcctgaccttgtgatccacctgccttggcctcccaaagtgctgggattacaggcatgagccaccgcgcctggcccaaactactttttaatgaatggcctcttcggaaactgctcaagggggaaagatgactctggttcttgcagccaaagtctgtttccctttgcactaagactgatttgtaatactcatcatagccgttcattttacttttgtggaatgaattccaggagaatttctcttttacaagcctatcaaatattaggtggttttgagcaagagctttcataagcagtgtgtcaggctaacccgcaataatgtgagaaatttaaaaaataatttgattattttccttacctctgcctccccagtgaatgggatgacgtgaaaagtgtgatggggatgacttcagaggcaaggctccgtcttcacagagagaggccatgcagcctggcttcacccagtcagaccacatctgtgattttcttgctctccttttagcctgacacactttgtttcttcatttcactttgatttttgagatataaatcgaaatccacatacaattcacactttaacagtataaaattcagtgttttttagtatttgcaaggttgtgcaaccttcaatatcaaatcccagaacattattattgccaaaaagaaaccttgtacccattagcagtcattctccaactgtcctagggaattactaatttattttctgtctctatggacttggctgttatggacatttcataaatgggaccatatacgatgtgatcttttgtgtctggcttttttcacttgctataatgttctcaaggttcattcacattgtagcatgaatcagcatttcattcctttttatgcctgaataatattccattgcatggataactgtcatttttgtttgtttgttttattatgtgtttttgagacagggtcttgctctgtcacccagtctggagtacagtagcataatctcagcttgctccaacctccacctcctgggttcaagcgattctcatgcctcagcctcctgagtagctgggatcacaggcatatgccactacaccgtgctaatttttgcacttttagtagagatggggtttcaccatgttgtccaggttggtcttgaactcctggtatcaagtgatctgcctacctcggcctcccaaagtactgggattacaggcatgaaccaccacacccagcctactcttttggtttgaagtgaggaacaattcaagttaccttaaacaaacaaacaaaagaatgttaggcctcacgtcactgaagagtccagaggtgtggtgggcagattccagaatgattcccaatgacccttgtccttgaaaagcctcttccccttgagtgtgggtggagcttgtgaataggctactactcctgtgacatcatatgacaacggggattgtgcagatctaattaaggctattagtcaattgactttgaggtaatcagaaggcagattagcaggtggacctgacctaatcacactagctgtttgaatctgggcctagagatcagagacagaagttaggaattcatatcacaagagtgattcaaaatgccattgacttaaaaatggaggggcccaaatgccaaagactcgggaggcctctaggagccgagagtggttcctggccagaagatgggaatcttggaaccttagtcttttcatgttttgttttgttttgttttgtttctctgcacccccatgtttattgcagcacaacacacaatagccaaaatatggaatcaacctaagcgcctgtcagtgggtgaatggatttaaaaaagtgttctatacacaatgggttattattcagccataaacaagaatgacatcctgtcatttgcagcaacatggatggagctagaggccatcactttaagtgaaataagccaagcacagaaagacaaatatcacatattctcactcccatgtgggagccacaaaggtgaatctcgtgaagatagaaagtagattggtgtctaccagaagctgggaagggtagggggtgggggcatgaaaagaagttgattaatgagtatgaatccaaagtcagatggaagaaatatttagtattgtgtagatcagtagggtgactacactttacaataaactattgtacatttcagaatacctagaagggggagccttagtcttgtaaccaaatggaattaaattgtgccaacaacatgaactagcttggaagcagattttacccccagagccaataagaactcaataccttgttctcagccttgtgagactttgagcagagcccagtactgctgggccgaacttctcacctgcagaattatggactaataaatgggtgttgttttgagccattaagtgcatggcaatttgacacaggaatagaaaactaacacaaaaggccagctgccttcaggtactgctgcatccgggtgctcagatgacatcaggaggccttcctgtctctgcgtctctccaggctcatttgcttagacttgttggtgcatttggaggatggctctctccttgtggtgatgacgcctccaggagcccctcttccttctcccagcttacctatcccaggggaaaggaagcctcctttgccattcatacaacagcccttggataaagtttcatttgaagggtgattttcacaagctcctccctaaaccaattgccacagcaaggcttaagccctggactgagcgagcagggctgggtccaccccacccatggatggagagctggggaggggtcgcttttccaaaggggactcaggacccagaaggagcagcaggtgctgggtgggaaaaccaagggtgtcccccacactcatgcatctgtctctcctgcagctcatggggcacagcctgcgctacctcctctgtcctggaggacccagtgcccatcctccatggctccaggatggagctggccctcccacagccctcaccatgggctgtggaggacagggtgttgaagggacaacgattcaggtcctgatcagacatccggctggagccctgacactgggcatctcctcatcctcctcggccatgactgactcttccttgtcatttctgagatggtggaagggagactttggagcatctgggcaggccctggtgaaatggctctactctagactttttgaaaaactaaaaaatcactttagggtcttagagagccatgcaagggagagacttcagtgtagctggatgaagacaaacttgggcacttggttgtcccttcagagctgggtctcggagctttcatggagtgccccggggaatacacaggctcaggagtcagaccccatgggctcaggtcccagctctgcctcttacagcgctgcaaccttgtataagttactttagctgtgcctcagtttcttcatatgtaaaatggatctgataataatgcccacctgaaagtgtgggtgtgaggatgaaatgagcgaacatgtgcttagtgtggtacatagtgagtgcctgctgaatgcacctgccatgatgctgagtgtgagtgcctgctgaatgtgacctgccatgatgctgagtgtgagtgcctgctgaatgcacctgccatgatgctatctgagtgtgagtgcctgctgaatgtgacctgccatgatgctatctgagtgtgagtgcctgctgaatgtgacctgccatgatgctatctgagtgtgagtggctgctgaatgcacctgccatgatgctgagtgtgagtgcctgctgaatgcacctgccatgatgctatctgagtgtgagtgcctgctgaatgtgacctgccatgatgctatctgaggtgtgtgaggatgaaatgagctaacatgtgcttagtgtggcacatagtgagtgcctgctgaatgcgcctgccatgatgctgagtgtgagtgcctgctgaatgcacctgccatgatgctgagtgtgagtgcctgctgaatgtgacctgccacgatgctgagtgcacatttctgctgagatagttaattcttaggtccatttcaaagatcaggagcctgtgaccaaatgttcagtacttctggaaaacacttccatttatgctgtctctgaattggcagcattaggaatgaaagagagataaattagatcatccaagatgattgctctgaatgccctcctcaggagctctttacagtgttacctcctaatgtacactgaaaccgtgcttggtgctgtcctagccaaggctagggaaagaagggaactaacctcctcagttattggcctaagcatctcataacctaccaggtagggcacaagatgttatatctgtgccgtttcctttactgttacatcaacttttgcggcatcacatgcattttgtggatgagtaaactgaagtccagggaagttaagtaacttgcccaaggtcacccagaaagtatcggagctagatttgaatctatgatggtctgcttccaagggccagaggatttcagctctacatcagttttattttttcccagagaaacaagagagaagctgagggcaccatctgcggtggattcgggctgtgggattgctgaatagtgtctacatttgtattaaggagtcattttgagagaacatttcgaaggctctccaatccatagcacagtgttttaccatcatttgtctccaggtgcattgggaaccatgtattcactccaggtggtttgagagggaatgtggcattgccctttccttgtttctcagaatccttatttcctctcctcattttgcccctttctccacaacgttcttttcaagactttgagtttgggcaagaatcgggcaataggttgcattgtcaggggcttaatgcctcagattttctaaggcagtcctgcttgccaaccttctgttcccggctcatttctgatctgagacccaggttgtgttggtggctttggtgactgcagaaccactgctctggagccattcactccacagtgaggttgacaccctgagtcccacaggccccctctattgcacccacactctgttgtgttggtgtggccaaagaagaggaggacagagaagcttccccagagatctctccatgctcctcacaagtggttttttttttgagatggagtctgtcacccaggctggagtggagtggcatgatcttggctcactgcaacctctgccttctggatttaagcaattctcctgcctcagcctcccaagtagctgggattgcaggcgcccgccaccacgccggttaatttttgtatttttagtagagatggggttttgccatgttgactaggctggtcttgaactctgacctcaggtgatctgcccgcctcagcctccccaagtgctgggattacaggtgtgagccactgctcccggccacaagtgttcttggctttgtttgtctctgcatttgtctctggggaggtatcacattaactttccatgtttgtggacttgtacctgtaatatgattacagtctatactttctagaattttctcagatcctccatagaacgacgtttttcgtggcagagattgtgtcttcagtgtgtcccaacagagcttgatctggaacctcacccagagtaagcgtggatttgaagcaccagggtcttggagatcctggaggggcttggccctcttagccaggcctgtgtggtggggatgccgaggggaggaatgatggatgggagagatcacgtgacagcacaggacactctcctggggctaaaacaacttcagcgtctgctgttgcagtttggccagcctggtggggatggaggtttggtgggaatttttttgtaagattcattaacctttttctcttcttgtttcccccttttcttttcctccattttaagcaggcaggcagtcttgctaatgtcagaagttagggtttggggtgatgtgaaagttaaggttaatgtttagcagatagtcaatcccctcgctctctgactgtggttaaagaactcatccctgccccactgactttgggcttggccatgtgacttgctttggccaacagaatatgagcgcacatactgtgagcagaggccgtgagtgcactgccacgagaagcgtgtgtcctggggagctgctgcctcttgtgcccgggtctagaagaagtcatgtgtcgtcaatccaagcccaacccgtagcctggagcagagctgcccttagaccgccccagatcatccaaaccttagtcaccctgcagactccaagtgtgaggacagaagctcgtgttataagccattgagtttgggcgatggtttgttatgcagcaccactgtgacaacagaagactgatatgggtggtgtctgctgggaggaactgggtggcaacggcaagtgaatcgaagaaggccgaagttattggcttttgcaaaatactgaaccagtgaagagatttgcccaagtgtccaggagggtgggagcctttggccagcagccaggtgggccgagccttctgcagagctgcgcaggcttgctgacgcctgtgtttggacagtggtggagacctggctgatgcctgtgtttggacagtggcggagacctggctgaagcctgtgtttggacagtggcggagacctgcattgcgttccctagagtgtcaggggtattgccagtcttgggcctcagacagaacagcctctactgcctgaggaacccctgtttgccagggattggtttaagcatctcctatgaccttactgtacctcctcagcaggtgggtgctgtcactggacagatgaggaaactgaggcatagagtggttaatcactgctcagggttgcacaagggataggtggcaacacgtggcgtggagtctaggcagtccgcttctggatgctatgctcatcgtcgctacactgcccgccccagtgcacctgagggactgcaagggccgagtggcatctcatgataaccagggactgagagcagaaagcttggcttccctcattcccaacgttagaccctggcaaggcctgtgatgtggacctcttctcaagttgggagaggaagaatggctgagatggcatttcctagcagcccagggggacggaggctgcagtcacaatgcagtggacttaaagaaaagaaagagacacagcctctcttacaccccggactcagcacagatgttcacccttgcagcccatggcgttggatggcaggcttgatgccacctgtctggcacaggcagcatttctgttggactcagggaccacaggctctaggtccctgcaggatccttggacatcactggccacaaagaaggggtctcccagatgtcacatgcaggtggccttgggctggagccagggccagggtctgacctggaactgcagaaagcagtatgtcctgagcttgctgctgactctggggaggaggcgcagctggccacggagctgccctgaagccgtcggaggtggggggaccacgtggctggagcacaagatgcacatttcctgagaatactttttccccaacactcccattgcttcatttttaaacaccccacttaattcatgtatagatctgaaatcacactgaacgggaatgtgagttttctgggtttgccaaaaggggacctgggttagcagcagtggcgagggggcctggccttgcaggggtgaaggtgaaggtgttggtgaactcagcttccctcctgcatgtctcgggaagatcatttcccggcccccatggttgaggaagagcaataaagaaccaaatctcctttgaaaggcatttgacaacatttaaactccgtcaggcagcctaaggatcattttcaataaattcatcttgagctaaagtttctgccttactgaattcatcttttgggagtgggtgtttgtccctgctgcagataattgtgaccctggatggcaggacctatgttcactgtgaaccaacttttcttgcgagggccccaaagaccccgagtgtgaatcgcccgagtgggtggggtctcttgccctgtgagtcctactaccaggggccccatccttccacccaccttcccccgggtctgtttcccttgaggtctgagctggggtgcccagtgaggggtcatccctgctgtgagataaaaccgaggtgtgactccccatccccatgcagggccctagaggtcatgcacggcttcaaccatctgaccgaggacggatctgactccctgctcagggcagcagctcgtggttcattcagccccagcggcgtctcgatgggggtaatgtaaggggcacagagaaccgaggattgggtctgatgggattaaacccccaactggtgtccctgtgtcttctctttcctgacaccagacaccaagaagaaacagccccaagcacatccgtcagtgcattccgaagggtgagctgggggccaggcggcctctgaagtctccacatgggttttgagcttttgcttttttgcagcagcaaatctgctctgggctgggaattggtgtttgctaaatgcacaggtggtctggagtgatgttttccttctttagcaaagtaacacatgctccttacagagagttagacatgcaaagaggcaggcatgttttttaaggataagttaaacattcagcaggttctcgggcactgagtgaaaggtgtccccacaggtcagcccctcagccccccagtttcttcttggagaagccagtgcagggccccgtgttgggggccggtgggtaggaggctatctcaagacaccaggaggcgattagagggtctcagtccattttgatacctgtgctcgggagtcgctggcttggactggactcctggcagcacccagtgagaaagggacaaatcaggctgtgactctggccgttttctcctctgcgactatgattcctttgctgcaccccctctttctggcccatccgcagagcacagacctatccttgccggctgacatttctctgctccctgaggctgagtgtgccccctggggatgctcagagagtgtccctggatttatttcagggccctcacttcttggaggagatgtcattccctgcagagctccattcacctgctctgaaccctcctcatcctgcccaaggacgtgctctctggtttggctggaaagaatgaccccaccatgccaactctgggattcaggcaaatcagagctgctgggcccaggctgcgttgtccagctggcccaggtgtttgtactgaaacacagctgtgtgcccactggttggtgcagagatgctgtctctatccctatggagaccctgtactggcaccccaagatacagcagcacaaggggcacaattgctggcccagcagaaacctggggaccctacactcgagctacggtcagtgtccacgatgactggccagctgccaagtgaacaaggacagaggcgtgggcagacgtgctgtggcctctcagtgctgggtgtgtgagtggccggagagggcgtctagatgccccaggtgtcttcacacccagaactgggtctgccagaccctgatggccccgagagtcctgaccagacccccgaaggccaacccaacatgctgggaatgaccattggtgccaagcgggccctgggcagctggggaagggctgtcacctcaaatgtcccactacctggctcctcctctttcctcagggacccgaatctgcccgctgggcacaggtcctcacacaaagcctggtccaggaaaaacaggaccacattgccaggcggcctgtccttcccctccccacaatctgtgctctaattacagaaatgacaggctcatggccagagacgccaagtaacagagaaagagaataaagtagaaaataagaatcattccccaacctacccccacacggagctagctgcattttaaataactaagcttcttgattgtgtctgtgtggaggcctgagttcctataaccgaggctgttttctctttttttttttttttgagacagagtctcactttctcacccaggctggagtgcagctgcccgatattgcgacctctacctcctgggttcaagtgattcttgtgcctcagctgggcaccaccatgcctgctcatttttgtatttttagtagagacgggggtttcaccatgttggccaggctggtctggaactcctgacctcaggtcatctgcccacctcagcctcccaaagtgctgggattacaggcatgagccaccgtgcccggccttgtctgttttctcttcatgagtgcccggtgtcaacgggagaagcagcactggcctgagcctctaagccaaagcgtccgggcacagctggggacaggcaacatggacccggtcactgtggtcctaatggtagattgtggtcctggttggcataggcagctcatcacggtctcacctgtagctgctttatggaaggtctgaattggataggagcagaaaacagcttcattgttctctagccgctgcattccagcagcttctgtgaggcaggggccagattagggtgagtgagtgaggccaagtcatgcaaatacagggtcatattgtgtcttagttgaaatgttgttaactttcccattagggttttttttttttttgcattgaatttaactttttaaaaaaattctgcactaaaatattatttattttgatcctgaattttttggtgcccccttaaattttatgcctcacttgctgcaccctgataatccagagatgagcgcctccctcccctgcctcgccctagtccccatcctgctgataggtctctggtctctgctccttgatgacatctggggaagttttcctaggattttggtcaccttgatttataatagcagacttgctaataatgagtggaatatggccaggcgccggctcatgtctgtaatcccagcactttgggaggccaaggtgggcagatcacttgaggtcaggagttcgagaccagcatggtcaacatggtgaaaccctgtctctactgaaaatacaaagattagctgggtctagtgatgggcgcccgtaatcccagctactcaggaggctgaggcaggagaatcacttgaacctgggaggcggaggctgcagtgagctgagatcatgccactgcactccagcctgggagacagagcaagactctgtctcaaaaaaaacaaaaacaaaaatgaatggaatagctcatgtttcggtgttacaaaatccaggccagacaagtctcaactttaatctcacgcccagttcctaggttagtcccttctccagctcaaattcagcctaagcctcaggggtccttggtcggggtggcaccacctgctcccttccccaactttgttcctgtttttaatctgctggggctgggtgcattcagaggtagggacaggctgaaggtcttcggctttttggttctgttgatgggtgagttccaaatactagctttctcttgtaggatatttcatttatttgttaaaaatatttatttagaacacaccattcatgtgccagacgctattccagccactggggatagggtgataaatgagataaacaaaaatactcgcccacgttaagctcctattctagggaagagaggaaaaaaaagaaaatacatgtgtacttagtacattagaaggttccaagtactgttaaaaaaaataaagcaggctggactcagtgactcatgtctgcaatcccagaattttgggaggtgtaggtgggcagattgcctgagctcaggagttcgagaccagcctgggcaacacaaaaaaaccctgtctctacaaaacaaaaacaaaacatttagctgggtggacagattgcttgagctcaggagttcgagaccagcctgggcaacacaacaaaaccctgtctctacaaaacaaaaacaaaacatttagctgggtgtggtggcatgtgcctctggtcccagccactggggaggctgaagtgggaggactacttgagcctgggatgcagaggttggagtaagccaagatcacaacattgcactccagcctgggtgacagagtcagaccctgtctcaaaaaaacaaaacaaaacaaaaaaaaaaacaggaaaaagaaagcagagatggggactagtggggagggggctggggatgagagcctccctgagcttccacagttcttcctgcccctctcctatctcactgggcacgggccacctggggcttctggttgttttgtgccaacttaatatgttgttcttgccaacagtcggaggccaactgaggcttctctgtcttccacaaggaacagcattggcctaaacctgcaggcaccattgcaaaggggagtcagctcaggtaaacctgctggtgaagcatgattccagcgtggggacacagaggctgatgtatcttgctgtaggtgatttaatgttgggcctcactatttcactacccctgtaagagtatgacacatccacgtccttaccagggcccgagggagggtggatagacttatccatcccataggtattgctcgtggctgggtaacttgcttatgccaacaagattttcatagacacggcacaggcagaagcctggaatgtgttggcactgccaggcctgccctctaatgctcttgatttttcccacgagacgagcgtgccccagggaacttcggctccagctgcaggatgagaggcgtgtggagcacgcagggttccaaccctcagcctggagtcaagcccagactagatcagcctaagcccagccaagccacgggtgcaggagtgaaaagcaaacgctaactgtccatgacattgactttcaaaggggcatgtcatgttatgtggctcatcccagcaacaatgaagatatttctccatcagtcagtcggtgaataattattgacaatgtgctaggaaggtggagtgattggagtagatttggtccctattctcatggagcttactttctagaggggaagacagatgataggtgaataaatataaattattctattaggttgatgcagcagtaattccggcttttgccagtaaaggtaatggcaatcaaaagcgggaggagccggagctgccattcattaaaagcaatgacaaaactgtgatgacttttgcaccaacctaatagaataaattacgagtgcgcaaaacgctgtgatgggaaagttccaagtgccaggatagcatctagcttcctggagtcaggagatgggggttttcaacctaagcaaggttaagtccaagtggtgggggcaggcggggggcgatatttcaggggagactccaaggatgaatggaaattagaaaagtgaacgcagatggtgaggggggacgggtttcaggcacagagaacagcatgtgcaaaggcctggggggaggacatcgtgtgttcatggactgaggggcggccagcaggctggagctgagccggtggagaggaggatggggagccggggaaaggcgctccatgcagggggcacagcaggggcaaaggcccggagtcaggcctgaacctgtgtggtttgaggaagtgacagaggcctgtctgggaggaaagtaacagcagaggggagaccataaggtcagggcagagggcagggccgtgctgggcactgtgggctgtggataggacctggcacgtatgctcgggtgaggggaacgtgttagaagattttaagaagggcaggaacatctggggataatgtgtattctaggaatctcaaccaagtaaattcatagtttgaatgttcacaagacttctgcacaggcaaagtgaaagatcgtttctagagctgtgagataagatcatagtaaaaaagaactactaagtttttaaaggttatttcaaatgatggatttccatcttacaaatgaatgcaagcaggttgcaaggttgatggaaagtagaaaagttttctgacttgcgtgaacagaaaagaaacatcaatttgaaaggaaaacatttatttatttacttcctctacagttttcctgactgctacatttcatgagaagggattgtttatgagggtcaaggagctggaggcctggggaggagctggtgtttctgttcaagtttgagggtcctggagctggagtccaggggaggagccggtgctgccactgatgtcttagggtcgtggagctgaagatcccagaggagccggtgctgctattctagcttgagtttcgtggagctggagacccagggagaagatggtgctgctgttctaatttaaggatcgtgaaacagaagacccagaaaggagctggtgctgccgctgctcagatctgagggtgttggagctggagacttagggaggagacgtcttgttctagtttcagggtcgtggagctgcagactgaggcaggagcattgttgttatagttcgagggtcagaaagctggcgacccagggaggagaggtcttgttctggtctgagggtcgtggagctgcagacccagggaggagcaattttgttgtagttcgagggtcaggaagctggcgacccagggaggagaggtcttcttctggtgtgagggtcgtggagctgcagacgcagggaggagcaattttgttgtagttcgacggtcaggaagctggcgacccagggagaggtcttgtactagtctgagggtcgtggagctgcagacccagggaggggcaatgttgttgtaattcgagggtctggcagctggcaactcggggaggagaagtcttgttggagtttgagggtcgtggagctgccaacccagggaggagcaattttgttgtagttcaagggtccggaagctggcgacccagggaggagaggtcttgttctattgtgagggtcgtggagctgccgacccagggaggagcaattttgttgtaatttgagggtccggaagctggcgacccagggaggagaggtcttgatccggtctgagggtcgtggagctacagacccagggtggagcaatgttgttgtagttcgagggtctggtagctggcaacttggggaagacaagtcttgttcgagttcgagggtcgtggagctgcagacccagggaggagccattttgttgtagttcaagggtccggaaactggcgacccagggaggagaggtcttgttctagtttcagggtcgtggagcttctgacccagggaggagcattgttgttttagttcgagggtcaggaagctggcgacccagggaggagaggtcttgttctggtttgagggtcgtggagccgcagacccagggaggagcaatgttgatgtaagttgaaggtccggtagctggcaccctggggaggagaagtcttgttcgagtttgagggtcgtggagctgccgacccagggaggagcaattttgttgtcgttcgagtgtcaggaagctggcgactcaggtaggagaaattttgttctagtttcagggttgtggagctgcagacccagggaggagcaaggttgttgtaattcgagggtcaggaagctggcgacccagggaggagaggtcttgttctggtctgagggtcatggacctgcagacccagggaggagcagtgttgttgtagtttgaaggtcaggaagctggcggcccagggaggagaggtcttgttctagtttgagggtcgtggagctgcagacccagggaggagccatgttggtttgaatgttgtggatctggagatccacggaggagctggtgctgcctttgaagtctgagagtcactgagctggagatccagagaggaaccggtgttgctgttctagtctgaacagatctagagttctggggagttgccggttctgcctctcaagtctgagagttgttgagctggagattcagggaggagcctgtgttgctgttgtagtttgagggtcatggagctgcagactcagggaggaggggtgcggttctagtctgagggttgtggagcttgagacacagggaggagctggtgctgctgttgtttaaggctgagggttgtggtgctggagacccaggtaagagctggtgctgctgttgtttaaggctgagggttgtgtagctggacagtggggaggaggtagtcttagtgtctaatgtgaggttggtggagctgtggacctggggtggggccggtgctactgtgtagtttgagggtcatggaactggagacctagggaggagctggtgctaccaccatttaagtcagagggtcatggatctggagctttggggaacagcccatgctgctgtttaactgtggggaggatgtgctgtgtccattgaagtttgagggtttgggagctggagacccagggaggagctgatgatgccattctattttgagggtcgtggatctggggacctggggagaggctggtactgctgttgtagtttgaggttcgtggaactggagacagggggaggagccggtggtgctgttcatgtctgagggttgtagagctggagacccagggagaagcccgtactacagctttttaagtctgagggtcgtggagcctgagacctggggagaggccagtgctgctgttcaaatggctcctttccgggtctccagctccatgacctttaaactaggagagcagcagcagctcctcccggggtcttccagctccatgaccctcacactagaacagcagcagcagctcctcccggggtcttccagctccatgaccctcacactagaacagcagcaccggctccaccctgggtctccagatccacgaccctcaaagtagaacagcagcactgactcctccccgggtctccagctctacaaccctcagacttgaggagctggagactcggggaggagccagggctgcttttctactttgaggattgtggagctggagacccaagatgcagcagctgctgctattctagtttgagggccttggagccagaaactttgtgaggagccggtgctgcctttcaaatctgagagtcattgagctggagacccagggaggaaccggtgttgctgttctagcctgacggtagtgaagctggagaccaaaggaggagctggtgctgctattctagtttgaggttagtggagctggagatcacaggaagagccggtgctgctgtttaaatctgtgggtccccgagctggagccctggggggagatggtgttgttcttgttcaagtctgagggtcatggggcttgaggcacagggaggagctgctgctgttcaagactgagggtcgtgtagctggagagcggggaggaggtagtcttggtgtctcgtatgagggtggtggagttgtggacctggggaggagccggtgctgctgtgtagtttgagggttgtggaactggagacctagggaggagccggtgctactgccatttaagtcagagggtcgtggatctggagcttttgggaacggcccgtgctgctgtttaactgtggggagcatccggtgtgtcaattgaagtttgagggtttgggagctggagacccaggagggatccgatgatgccattctattttgagggtcatggatctggagacctggggagaggccggtactgctgttgtagtttgagggtcgtggaagtggagacaagggtaggagctggtgcttctgctgtttatgtctgaggattgtagagctggagacccagggaggaactggtgttgctgttctagtctgagggtagtgaagctggagacccaaggaggagccggtgctattattgttcatgtctgaggattgtgtagctggagacccagggaggagtcggagctgctgatctagtttgaaggctgtggagctgcagatcccaggaagagccggtgctgccgttcaaatctgtgggtcttggagttggagccctggggtgacccagttctttcattcatgtcttaggatcatggaactggaaacctacggaggcggcggtactgctgttctagtttaaggatcgtgaagctggagacctggacaggagctggtgctaccgctgttcaaatctgagggtcatggagctggagtcttggggaggtgccggtgctgcctctcaagtctgagggttgttgagctggagattcagggaggagccggtgttgctgttgttgttggaggattgtggagctggaggccaaagaggagctggtgttgcagttcaattttgacggtcgtgtagctggagacctagggaggagctggtgctaccactgtgtaagttgaggtttgcagagctggtggccacggggaagagccagtgctatagctgaagtttgagggaactggagacccagggagtagccggtgctgctttctagtttgagggttgtggagctggaggcttggtggggagccggtgccgcctcccaagtctgagagtcattgagctggagatccacaggggagctggtgctgctgttgtagtttgaggattgtggagctggagacccggggcggagctggtgctgcagttggagtttgagggtcagggagctggagatctggggagcggccagtacagctgtttaagcctgagggtcgtggagctaaacatggagccaaagttggggaagcagagagagagagttacaggatgaccctggaaatggtagacgtagctgtaccccaagcaagctaagcttgggaactcctcaatgctagtgatgaatgcattctttttcctcttacacagtttggatttgttttctgtgtctcatgagacagaaagatcttgattaatacccttaggaattgaaaagcttaaaaaactaaaggatgttggtaataaaaataataagaattaaaccatgattatcctggctgacagagacaaaatcacacacacacaatatatatctttcaatcagttagcaaaattaaaaaaaatggaaaaatagacgcaagcaaagctataaaaagttgtttcatggagaagcgatggaggacagcgattaatctgagagttgctattaatggagaaactgagaacttaccatttttcccatgaggttttggtgtagaatgatattgtgtgagttctggcagctgagtcacttcacacagcccggtgatgcagtaggtgtcacagaaggaccctctcccagttagttctgcctcactgctccggtgagtgcggcctctgatccccaacagctgactgtgtgttgagaccacgcccatgagcacaagggtttccacggtgaaggttcctggatggaacactgtggatgtccctaatgttccttcctgatgttcatctgccatcttgctatttaatgcaatgtcttctaaatattgaatagaaaaaagtatttgtacaatatgggcaaggtataaagaatatccacacactggacacacagacagagaggggcacccacagcaaactccctttgcctgggagcaggtgtggtccttgagtcctatgttgcctgtttcttcctccgccttggcctacgggcccgatgtgatctgacctctgcctgcctctccgactccatcccccctcccgctcctgttctttctaacaattatgttacagcctcagtgaatgtgacaaggaccctgaatgacggtggctttactaagacagaggttcattcctttcacatgaaagtccaagccagtcgggtcattcttctctgtgcatttttcagggtcttaggctacttccatcttgctgctctgacttccttagggtatagcttcccccacagtgtccatcctatctactgccagccagcagggaggggagaagagaacaagaggacacaaatcttccttcctctaatggcagttgctgtgcactggcctcatgtgcattggtcactgcctggtcacgtggccactgcttgctgctaggggtgctgggaagttttcatcctggatgccagtgcccacctgggtgactcctgaggttgaggggagagaggacatgaaagagagtcactggctcttcccaccatcatgcatgtcgttccagtctagggcgacccactgcctcagcttgctcaggactgaggagggtcatggggcacagacctctcagttttataacagggcagtttcaggcaaatcatcccagcttggctgagactcagaattttcctgggatatgggatttctagtgttaaaactgagaaagttctgggcaaacctggacaagttggtgcctgccatggggcctttgcatctactgttacccctgtctgggattccctttctgcagctctgtgtggtgctcactccttttctgttgaggaaaggctgctctctgggtgtccccgggtgcctgttccgctctactcagcactacatgctctgtgaatatccctccatgcacttcgtagaatgagatctgttctttccacccttgcctgcccacttcagtttcaaagtctctgaggattattcatttttattctcttcagcactgaaagatacatctctttccctaaggctgtggctgggttcacgcatagttagataaatctgatattaataataacccgaatgaaaaacatgtattgaatcccaagattatgatgtaggaagcacggattctgaagagatgtctaagcctaataaaggccaaagggtgtggattaaaaggaaatgtggggtggagaaacatttcatgaaatagaaccccacctcttgggtgagttcgttggtacaacttttctagagggcaattttgcaactggccaatgaaggtgagtaacttttggtcccaaatttcatttataggcattgatccctaggaaatagtcagaaaaatatgcaaagatgaatctcaaggatttttataagaagaaagaagtaggaagcataaatgcccactggtggtcccacaccctggcaccagtgctcccctctcctagtgggcgggcacaggctacattttcccaggcttccttgcagtgagttgtggccatgtgaccaggttctggccaatgggaggcaataaaagtgttgggtggtatttttggagacccccttctgtaacttctgtcttgatatggtttggatgttggtcccctccaaatctcatgttgaaatgtgatccctgatgttggaggtggggcctggtgggaggtgttttggtgatgtgggcagatccctctcacaatggcttggtgccatcctgatggcaatgactgaattcttgctctgagtttatgggagatctggttgtttaaaggggttggcacatcctcctccctctcttgctctttctctcgccatgtgatgtacctgcttccctttcaccttctgccatgattggaagcttcctgaggcctccccaggagcagatgctggtgccatgcttgtacagcctgcagaactgtgagccaattaaacctctcttctataaataaccagcctcaggtattcctttatagcaacgcagatggactgacacatatctttaatgtcatttcttagttgttccatcctttgacctgcttcctggaataagcgtatgatggttggagctattcttgtcaccttgaaccttgaggattaggcttctaccctgcggatagcagaatgtcctctggaaggaaatgaaagtccctaacgccaccctagactgagaacctccagttttgtttttacttttttattttttgagacagactcttgctctgttgcccaggctggaatgcaatggcgtgatctcagctcactgcaacttccgcttcctgggttcaagtgattctcatgcctcagcctcccgaatagctgggattacgggtgcgtgccaccatatttagctaattttttttatttttagtagagacagggtttcaccatgttgagcaggctagtctcgaactcatgacctcaagtgaaacacctcagcctcccaaagtgctgggattacaggcgtgagcctctgtgcccggcccagtcttggttttcatgagataaacttctgtcttggctgaagttaaatcactgataggtgatatgaccataactggataaaaagtaggaaattcatgtaatacttatatctacatatgcccataccaaaaatgatagtgatctgttgttatctatgtgtaaatatggacacaaaatattgtttagtgtaaacaaagctcttcttttttttttttttttttgagacagagtctcactctgttgtgcaggctggagtgcaatggtgagatctcggctcactgcaacttccgcctcctgggttcaaacaattctcctgcctcagccttctgagtagctgagattacaggcacatgcaccacatccagctatttttttgtatttttagtagagctagggtttcaccatgttgtccaagctggtctcaaactcctgaccttcagtgatccgcctgtgtttacaggcatgaaccactgcacctggcccataaagctttattctattttaatgaagcaaaaatgcataagtgtgtaagtgtgatcatatgtgtgtgtatgtctaacaggagcactacatagcaaaatgcgaatgctgcttatctttggtgttggtatcacgtgtgatttaaaatcttttcttctatttttaaaaactttcaaaatgagtcatgactttgattattagaaaagaaatctataacaattgagaggaaagaaaaccccacctgttgttgaaactggctggagctgggagaaatgagagattcctttgcaggtgtcacctccctaccagaaaattggccttgcaggaatgtcccacaagccagatgtgtctctttcccccagtccctgtgcctggtgtgaggtcgtacagacagtgagcatccttcacagagtctgacctgccaaggtaggggggaagtgggggtttagtgacattcaaaacccgggggagccgaacaggtgtgactgtatgtttgcagggtgacctctcccctcaaagagcaagaaataactctagtgcaatttccaaacatttacaagagaggatttttaaacttttcacttctttattgcaactagcacatttggaaggataaaatacagaaagaagtcctgctatttacaatcaactttcactaagccagtgttatattcaaaaacagcagataaagctcatggctttgatgaaaggggcagtcttttcattggaaacaattaatactgctccccgttctggggagaatttaaagaaaataatttggaaggggatatggcttgatacaatcaaatgatttcagatcacaaatgtaatcatttgatcttgctttaaaaccaaacatttcagaacaatctagcatcacattctcttctgagtctgtgaaactctgaattctgggtgagtctgaattcccaaggcaggactgaggatagaaaagatttgatggcagaaacctggtactgtggttatcacgtgggttaaagatgtaggcttggttaacccactgaacctgcttatgtatgaggctcacctgagaaggtgatatggacaagcccatcttatgggtctgagggctcttcaccaggagtggagcaaggaggatggccccagcgtccccgtctctgaacacgtttagcgggagggctgtagagcctggacagatcaccactggctccatggggaactttcagcagcactcattgcctgtgtctattctgtgccaggcactgcgctcagggcagggatttgggattcaccagggcacaaggcgacgtgcgtctgtcctcacggagcctaagtgctggtggagacggacagtgcagatgccaaccgcaaatgacgaggcacttgcaggtaggggtcagcgccaagaaggaaatgaagggtgcgtgtcgctgactgagactctggtgggagctacttaaatagggccatgggggagggcctctctgaggaggtgacatttgagctgaggcctcaccaatcagaaggaaaaagctgtaaagggtctgggattaactcaacctggggacttttaaaataatgtaaggtgttacagctcttttagaatttgtctagcacgttttccggttgtcactcccaggtgggctcgggaagaggcatctgtgccagctcgtggcctgttctttgcacttgtggggaaggggtccccttttcccacagccgtccccccggggcctgctcccaggtggggtctggttttcaccagaaagccctccatgcaaaaacaaaaaacaaaaaacaaaaaaaacccaccacacaattgaatttgaattagttgccagcatttacattttaattctaaaaatctgtattttcgacttcgttggaaagtcagactatctggccaggctgggctgggatctggtggagttcagtattttggtttctggttagggagggtatttggggtttgcccctccagcatctgttccagtgtgaagtgggggtggaggcccaggctcagtggggggatctgcagtggccaagggtcttggctgtctccagatggccggatggacgctgccccctcctgcttggggtgtgctggggttctttgctgcccctcctcccagcccacagcctcttgaactccacggagaccacccccatgtgaggctgggaagggaaacctgcctttgtaagtggaatcaggtgaaatcgggctgtgactgtgtcagtcagaaactaaaaggccctgtcacacccgtggccaggaagactgtcaccatggtggcatggaaatgacagagacgtgtgggacagcgtctgccaagagacgagccaggtgagggcaggtcgtcatgaaggagggaggtggggtcctccccacagagcagcgccatcccacagagaaacagcctctggggagggacgcgttccaaggaggccccgtgcagtgcagagtgggtggctcgaggcctgaatgccgggcactcggagcggtcagtgtccccgtgggagcagggctgctcgcagccaggtgattggcgaccttggatggtcagcccctgtgtgcgtgtgagggggtggccctctcctctgtctcttctgaaggcagcagtaaaggagggaggccaaagagctcagtgtcagacgagcctgggtgcaggtcccactgcctgccaggccagtgcctctgagcctcagtttcctcatctgtatagtggggttaatcccaaccatgtatactgtctgcctgccatgtgccaagcccttctaacacatctttgattgcctgagggcagggactttattatccacctttagagttgagaaagaagaggcacagaaaggttaaaccacttaccgggggtcacacagctgctatggcagagtaaagactccagactcaaatggagcactaagccccgccctgggcgccaacaggtgctccaggaatgtcaggtgccatttatcaccctcatcacctactgggagcgctcgtcccatcatgcaaaccccgtgagcgtgaagtgaggggacacgtgcaggatcgagtgtactggcgggtaatgaaagtaaagtaataaccacaggatgatattcacaacccacagtagtgctatcaacagccgcatctgcctgcttctctgggcccaggattgcctgcaaactcccaggaactggtcctaggtgggtcagaagaagggtctgacgttatgggaaggagcagcttgcccagctcatggcctgtactgtgcattgggagtccctgcccccaacagctgtcctccagggcctgctcccaggtgggctcaagaggccacagagctaagcagctttaggccagggttctgcgggttactgtgtgcctgtgggagtgacacccccacccccaaccttcctgccctgccagctgctggacacacagcagctacagggcatgaaccctgagaccaggacctctgtgggtcccatggcacagagccccctcctccctgcccgactgagaaggaggaggcgcgcctcagggtgaatcctgccccccctcccccgctcactgcaggataaacggcctctagatcgaacacctcacaacaggatgtgtcttagcgtggtttatcaaatcacaggctgtgatgcattagtgggtcttgaaatcaatttagagtgtcaagcccggcattgaaaatctgcaatagaaccagaatagactaggtcaggaggcatcagagcgcgttgtgtgcagcgagggtgagtgtcgtttgggtaaacgtgctgcgtatctgtataaatggatgtgcttgtgtgtggtgggtggcagtttgcaatgtgtttttaggtgggttgcactaaaaacgttagagaatctctgtctcaccgccttacggtaacacaaaggggaatcacctagtagtgatcattttcctcagaaccttacatttccctgatttgagaccgtttataagactgagaaacaggtctaagctggtgccaagagttttggttacgtcagggataaggctgtggctctctcatcccacagtccatgctgagggctggaggggaattgaactgcaggatgaagtgatgaacatgcaagaaatgagaccgggaatgggagaggcttgcaaggcaaacagagatggggagaggaagggacgtgggtaggggtgggtgactgtgagggagagaaagggggtgaggggttatttatgaagctctaggagctgccttcctagagtccgtgccacctggactcaaacactcattgtccattcaatgaccccttggagcttaagagctctgttaggatctgaaatgtgtccagcagatcttcggagccattgaattttcatcccatgtgggatctggacacatatgcatgcaaactaacatccttacacatatgcacacacagatacacatgcccccacatactcatgcatccacgtgctcacacacagatacactcacacatatacattcatgcacatgcatgcatacaatgcccacacatatatgcacactgatacacactcacagacacactcatatgcacacacacacatagacacacttatatgtacgctcacacacatgctcactcctacatgcactctcccacacccacacatgcccacgcactcacagacacagtgagtcaggtgtatttaatacgcagttcgtgcctatgcctcccccagatccccatgtgacctgctcgttagaggaggcccggagtccttgggggagccctggtgtcccgccacctgatctccatgacaacccatcccgacaccggtttgtgagtgtgaaagcttcagggcccacaggacctcccacgttaattcatggagatcagctgttcactactcaatgctcccaagttatgtgaggcagcgaggcacaaaattggcatctgctgtggtgtgtgtgtgtgtgtgtgtgtgtgtgtgtgtgtgtgtgtgtatgtggtgagcttggtgcacaggtaggatgaggtttggggcaaaagggcatgaacgatacagccaatagtaattgggttacagttgttgattgctttcaaaggacttaacatagaatattcatcccaaagatatattacatctggtgaattctagagcatctcacagatagaatgggggtaaaaggagaaacaacacacttgcaaatttgatgaaatttcccacatggtcctgaaatcgctggtggaatgggggattgcagtccgggtatgaggcattcgagagaatctgaatgtgtctcccaaagtgctccccagggactagcactgatcaggccgtggaaagcccaaggtcccacatgacaggttctgggctctgccttccttgaacacaggggtggaggggctggggagagaggcagagtctgagaatggctggagaaaatggtcggattcggttcttttatctgtagcagggactcaaacccagggtgtcctggctgctggaaggttgaacaatgctgagccgtatttccacacatggcttcactggctgaagcagggctgtcctgtggctgagaacccctcttccagccctgcatgggtcccctgacccccaggcctgcaggcattcacatacccccctgcaaagcccccaaccctccttgggcaaggacaggcacagcttcaggacattgtcctcctgccctatgtgggcagagttgagcccccagagcagagagggaggctccccaatacccatctccccgataatggccaatgcgcctcaaagggtcacttccaaagaatgccaggtggcaggcaccaggttttggcatctgatacgctcccatccactccctggggacctaagcaatcatcctttataatctctgacggggaacaactggccgttgtcctttaattagcaggggacacactaagctatggtctcctgcaggctccataaacatccgtgaaatcagcctggtgactccaagctcggtgcagactgcgggggcccacagaggccaaggggagcccccgcccccggtctggctctgagaacagcctccaggagaaactgccaagccacccggactcatggcagctgcttaaactggcaagttctttcttgcaaattgagatccaggctgcgatctgggctggctctgcacattccagccacctgttttacctgctggttggagctgccttggtacctctgagggctgcttgtgtgtgggtgggggctgcttttgaacacatggctgccccgtgggccgcgccttctccacttcttctggccttataaaatgatggttattgcagggaggatgcagggccaagcatcctcttatgtagcgccgtgagatgtggggtgtccagtgtcccaggagaaattcaagcctcatttccctctgagacactgggatggggccacgtgcagcgtcttagtgcctggatcccaagtgtgtcgtctgagtctgtgcatgaggggccagggccaggccttaggctgtgtaggacggaattgaagcatgtttgatgggagggcccaggtcacacccaccaggggccaggagtgcacagatgtagatgccaatgccagcccaagtcacccaaaatggcgaaagtgagctgctgggaaaccttcgggccagaggctgatgacgtggaatcctggaggggactgcctgctgctcagggtagaaggggacattctgatgcggcacccgtgacagccctccagtgttcccgccacccagacccactgtccctggagacctgcagagggaaccactgctgacgagaaagtgtctccgtcacttgctttgtttccccttggtcactgcaaacacatgctcacagccctcgggtgacaagcctctttccgcccccttctgatgcccctgctctatgggtgttgtcactgctcctggcttgcagtgtcctgtgtggctatgacaacctgggttcctctcagggccggtgtccctcctgcagaaagctcaccctgtctcctgggccctggccctgctcctggacagaggagggaaggactggggtggtggctgatggattctcatgtcacctctttcccatattcccctgggctcttccttcagagcctccaccctgcaccctgatgactcactgtgtctcatgtaggaagcccccggtgacatctcatgccctgtacacaggtccctacagcccgggcccctccttagctctgctgcctctgggggaaaccccactttcagccctccccctactccttacatctggcagggattgcagggggcttgttggagggaagccacatatgagactcacacgatgcaccaacgcccactgtgcagaccgcaccccatctattttcttccgtcccttctgcagtcaacacagccctggctctgcattcggccctctcttcacggggctgtgtctgggcagatggggctggaaaacaactcgctgggcccagctggggtgtgttgtgaatgtcacagcccggcctgtgcaacaggaggctccaggatccctttaggggtagggtagggggcgggagagtgcagattaaatgggatgggcaggggcaggaaggcagcaggggtgattaatttttctagaatcgttgccaggctacctttcaattccttgtctgtggcccaggccaaggaaagcgaatgttctgctgccaacctggcttgtcttttaatcataccctttgcttgtcagtttagacacccggtatactctcattgctttttagcaatctttgcaacttgctggacttttccacccaaataagaatcatgtgtactgtgtgccaggcactgtactaaatgcattagctatttcaatcctcacaatagccctatgagatgggcactatcattatccttattctgtagacgaagaaattggcacagagaggttaattaactagcccagagtcactcagccagtgagtggcagaactgagatttgaacctaggctgcttggcttcagggtctatgctcttaatctctcactgtaggggctcttaagtgagtcctcagcttccatggcttcagttgaagggacttctctgtggaggcagggccaggaggaagtttatccatgggtcctacagcagccatctagaaggatgggattggttgtgactcagactctacccttgctgctgcctctgtcaggagctctgtcccctggctcatcccaggatctgctccttccccctcctcaggactcaaatgcagcattgcagaggatgtttgctgagcacctgctatctgccaggcactgtgttagatgtaggggatcttgcaacaaacagaattcctgcttttatggagcacacattcagtaagtggagagggataaacaaatcagtgaaaggtatgcatgtcagctgctaatccatgctacagggagacattcagcaggctgggggataggaagctccaggtatgtgggagagtgtgttagcttcctgtggttgctgtgacaaatcaccaccaacttgatagcttcaaacaacacagatggactctgtcctagctctggaggtcaggagtctgccgtctgttttaccgggctaagtcaaggtgtcagcagggctggctcctgctggaagcactgagggcaggattctttgtgttttcaagtgtttgtatttttcttttttcttttcttttctttctctttcctttctttctttctttctttctttctttctttctttctttctttctttctttctttctttctttcttctttctcttccttccttccttctctctctttctcactttctctttctttcttttctttcctctctctctttttcttttctctctctctctttctctctttctttttaggcagactcttgctgtgtcgcccaggctggagtgcaggggtgtgatctcggctcactgcagcctctgccttctgggttcaagcgattctcctgcctcagcttctcaagtagctgggactattggcatgcaccactatgcccagctaatttttgtattttttagtagagatggggtttcagtataagttggccaggctggtctcaaactcctgacttcgggtgatctgcctgcctcggcctccctaagtgctgggattataggcatgagccaccgcacccggcctgtattttcttttaagctcctcatattcctgggcttgtagccccttcctccatcctcaagcacatgattccagtctctgccctgtcatacagctcctctgactcagaccttcctgccctcctcttataaggacccctgtgattacactgggcccacccaggtcatctagagtcatctttctatctcaagatccttcacttaactacatcagcaaagcccctttgcaatggacatacacacagggcccaggggttttaatgtggacacatatggggggcccttgttccaccccctacagaaggtggttgttgattttcagtaggatggtcagggaagaccctgctgagaagccaccatttgagccaagactggaggagctgaggctgtgggtcaggatgacatcgagggtggagccttccaggcaaaagaacagtgagtacaaagccggcaacaggtgtgctggcatgttccaggaaaaccagggagggagccacagctgcggccgagtgaggagaggagcagcaggaggtgaggccagagaagccttgggggcagaagctgcgggcctcatggttatcatgaagctccgggttttactctgagtacgcgggagccatggagagttctgagcagaggaagcacaggacctgacctgggtttcacaggctttctctggctgctgtgtggaaaataggtaaatagggcaagcgtggaagaagggaggcctgtcgggaagcttttgcacaatggcccgggtgagaaagaatcatggcttggaccagatgctgggatgtgtcccccacatccctttcaggagcaggcatgcatgccccactgcccagggggttgcctgctgagagctcacagctgagaccctctccagaaaatgcccctggctgacaggagctgctttgcccagtcacccttcctacggtccctgcatctccaaagactggtagtaaacacaggggtctaaaggtccagccccttgactcgattcatcacagctctgaagggccgtcttcgctgcagacttcctcgaaggatggattgcaaagtcatgcgtagagtgtgcagggctcaggtgactatctatatgtctgtctatattttaggatccctgtctacattagcaatttgtttaaaaatatatttcaaaattcctgtgcccacgtgaggtctagtgatttatccatgaaggtatagaataacagatagagaaggggtacttatgtggtttgttgtccgacagatcgtgtgaaagtttttcgtcatgtccaggcaccacctcttcctggtcaggcccacgttacatatgagaacaatggaacaagtcaaaggtaaagcaacaagtccccctgtaaaaaactatcagtgtaaccgtccacttccatatctgtccagtcagttaacaaatattgacagaccacctttaaacacaggctgctgtgctggtgtctgggacacagcagtgagtaagagccatctgatctcatgacactctcaggaagttccagtctatgaggatggacagcatgcaggtcaacacataaacatcattcagactgtgaaaaatgcaataaaggacacagattgggagatgggataaagagtcatgggggtggagctactgtctcattttgggtggtctgggagggcctctctgaggaagtgacatgtggacagagttctgaagaataagaaggggctgccatgggtgatttgagggaacagcatgctaggtggagggaatagcaagtgtaaaggccagagatcaggaggatcaaatatgaggccagggtatccaagaagtcaggacagtgctaagagatggggatgcagagacactgtgaggtgagatagaaagagaagggagtcggcctggcacggtggctcacgtctgtaatcccagcactttgggaggctgaggcaggtggatcacgaggtcaggagatcaagaccatcctggctaacacggtgaaatcccatctctactaaaaatacaaaaaattagccgggtgtggtggtgggcacctgtcgtcccagctactcgggaggctgaggcaggagaatggcgtgaacccaggaggtggagcttgcagtgatccaagatcgcgccactgcactccagactgggagagagagcgagactctgtcttaaaaaaaaaaaaaaaaaagagagagacgggagccaggcatggtggctgacacctgtaatcccagcactttgggaggcagaggtgggcagattgcttgagcccaggagtttgagatcagcctgggcaaagtgatgagacctcgtctctacacacacacacacacacacacacacacacacacacacacacacacacacacacacacacaaagccagatgtggtggtgcatgcctgtgatcccagctacttgggagacaggaggatcacttgggcctggaaggttgaggctgcagtgaatcaagatcatgcccctgtaatccagcctgggtgggtgacagagcaagaacctgtgtccaagaaaaaaaaaaaaaaggaaaaaagaaaagggaagagaattgtcacattttattgcaatgactgtgttttatttcagttaaaaaattttctctcccctttgagtccagcctgacactcaggagatggggagagccttcctctcactctgcctcaggaggagctcgaacctgctcccttaaatctccatcagctccggcaagcccttgggctctgctggctgtaacgctgctccctgtttaccagaggcttttgctggcacattaaatgtatcactcataccctgaactagatcgagccacagaaagctttgattcatggagctgctggtccccgttaccacaagatatgcattctttctctttgttaaggaattaaggtgccatattgaaactttaatctttaaatacaggtaaataaaacatgattactctacagaaacaggaccccaagggaaatatgtgtttaatagctctagcatttggggcaataatttccacattccattctgtttgtataatgtattatactttccaaaaatattttctcatgcaccagttcatttgtgctcatttaatatgtggaaggtatttacatgttgcacatatttatagcagttttcccaaccaagtaaaaagagaaaaagggaaaagaaaaataaaacgcctgcaggtcctcagttgcatgtactttctggtcagtacaatgaactcacatttgcattctttccttgtctcttatttcatccttttctttctccatggtgtgtgtttaacattaaccataaaccagttcttctcctctctctttcactcataaacatgtaggggtgggcagcttttgctcttgtccatccaacattcattcctccttctaattgcactgccctaattttattctcagcaatgacccctcccctcttcaatccacgtgtgtgtgttgactttactaagaccccagccctagatttggtctcatgccccagacctggacaatcagtgtattctctctctccacctccactttcattctcttaggtcagagtgattcctgggtggccaatgaaactttggtttgatttactagactttggtttgatttactagaaagaacacctctctttttattggattggtttctgtaagagtgtaagcagggccacagagcagaaacttcttgtttgtgaaggcactgcacaggaaaatagagccttgtagacatcagtcatttgagcggctggatgcagccatgcctgaagccatcacccttagggcaggttttctcaaccttgagactattgacagtttaagctgggcatttctttgttgtagagactgtcctgagcattgccagatgtttaacaacatccctgacctctactcaccagatgccagtagcatgccaccctcccacccgccactcccatcgtgacaaccaaagatgtcttcaggtgttgccaaatgtccctggggagaaatttcctccactaagaaccaccatcctagactgcccataagttatgcaggtcaataattatccgttttgcttatttctgcttgagtttctgttcttgtcttcaaggggctttctgcccgaaggagagctgtacctttaggatggaccttccaaaggaactttctctgaattgcccagtgtggatggtgagagggacagtctgcatttggtcaggtccatgagggagaaatgtaccagagagaaagtgttgagtgagcacttgtttatgaggtcctgaaggatcaggagaggaattgatccccgtagcctctcatgcttagggaaggcttcctggaggaggtgaatcttacagggttcataggggtagtaaagagggaggacaggtttgtgtatgtgtatgtgttggggggaacctgtgagcatgaaacaggatggaatggggtgggtgggttggcaggaggtgctgaggagatcatctggccaaagccaaagaggggtgtgtcaggcaatcatttgcattgggctgacagatgggtccagagtcaatgccaagctaaataagttagaatttaaacgtccaaaacatatttaccaccatcaccatgtgtggtagaaaaaatgatggtcccttaaagatattcatgtcctcacgcccagaatctgtgactatgttacacagtgtgataaacgggactttgcagaggtggctaagtgagggaccttgggatggggagatggtcctggattatctgggggagatgaatgtaatcacaagggtccttgtaagaaggaggcaggaggacccgggtcagaggtaatgagatgatgcgagcagggcgaaagaggaggaggtatgaggacgaaagtggaagggggagtgatgtcgttgcttccttaggagtgggaagaagggccatgagcagtgtaatgtggcagcctgcagaagccaaagcaggaaagtcagcagcttctcccccagagcctctggagggatgcagccctgtggacccccagataataaatttgtgtgtgatttttcaagccactaactttgtggaaatttgttacagtggcaataggtaactcatatactgtgcttgcccaattagcatgcaatttgtatgttattacttgatttttttttgtttgaattgactctatttactttactccaaatgaagatttcaccctcggtgttcatatctgtgaaaacatggggttgatggctgagtatacatttttccccaaaatgaatggaaataaatacatgacttaaacatgactttaaaaaacttgtttgtccatgttacgtgtgaaatcatctagtgtcttgctggtggtctggtcacatatactttggactcattagtgggataaggagagttgtggaagtcttctgaacaggggagggaggtgatggaaagtgccacagtcttagtagactccatgtagatggagtgctttggatgtgttggcaaagggaactacagccagggtcagcggggaggggttccaatagttagcaagaagacatgaggtccaaactgtggtggaggatgggaatgaaaaaagagcaaaagagccaatgggaaacaaaggaagaatgatcaggatcattactgatcatgaaactgacccaatagtcccacagagagttttttttttataaacatggaaattggcctttctggtcttaaagcttgaaacttatatttgttttatctgagttccttcctcaagaaaggatccctaggccttcaaaagtatcagagaactgaaactcacagattgccacatgcagacaatgaaatacattcaagatgattgtttctttgcccctccctaactcctgtttgcttactcattgttacatttcttctctgctgtataaaaacccctagttttagttgatcagggagatggatttgagactgagctcccatctccttggctgcagcacccgattaaagccttcttccttggcaatactcatcatctgagtcattggctttcagtgtggcgagcagaaggacctagaccaaacccctggtgttttggtaacagtcaggttgctgaaaggtccaaaactaagtcagaaggaattgccaaggaacaatggggctgaaagtgtcaggaaggattgtctgatggcaagcaacagaactcaacttgggctgtactcacagaggagaattgatcggtaggctatttggcagctcagagaatcaaaagaaaggcaagaaaccaggtttagaaaaagaataagaaccgaaaccatgtcagggcatggagagtaggaagttatgggcaggcccggaagggcatcactggtcatatgaatagttcttggttgtttctgtagcccgtgctgcttctgttaagatccaaggtccagagagggctgggacctcccagctgaggtctcatgcctattgtttggtgaggggagggcagggcacttcaatttaccatctgcctcagacttcacaacagggaaagttaattctccaaaacaaagtctgaatgtcaagcacaaggtgaggtaaggctgagtcctgaaagatttggccgatgaaggaacaatgagccctgtttagattcagctggcttttgacttacctagagtagccaagggtggtagttctaatatggtctggatatttgtccctgcccaaatatcgtgttgaaatgtaatcctcaatgctggaggtggggcctggtgggaggtgtttggatcatggggtcggacccctcatggcttggtgctatcttcatgatagtgagttctcatggtatctggcatttaaaagtgtgcgtcacccactccccctactctctctccctcttgttcctgcttttgccatgtggcatgtaggctcctgcctggccttccgccatgactgtaagcttccagaggcctcccaagaagcagatgctggtgctattgcttcctatacagcctgtagagccacgcaccaattaaacctttttgctttataaattacctagtctcaagtattcgtttataacaatgcaagagcagcctaatgcaagctcctagggcccttatgcagatgacacctaaatagggcctgaatgactgccatgattaacgggacaccctatgcagaggagccagtcctagagtgcagccaagtagttttatggtctgcaatgatgttctgaggggcaagatggaaaacatactggaacctgcctggtagtgagaaactgtcccgtgagcctctcagggagagagggaggtgagtggaagatgcctggggtacctcatgttcctggaggatactaagacattctgccaagaatccaatgagccatggttcaagccttgcctgcatggcttatgttgatatgtgcaagaccataagggtgccatggcagatttgttcccctgcattattttgaaaagaagggtaatatgtgttgggaggttaaaataaaattttgccactataataaccagtccaaaacaactccagggcttcagtcatctgggaaaatggtcggtagctggccagtgggatcccttacccaagtagacatttctagacattcccacatgtctgaagggttggcattttggagggcacatatccaagatttgtggctggtattttgtgtagatgtggcagacacttaagggcactgagagtgacaaagctgacttttacatcaatctcagagcaggggagggtagggctgagcaggatcacagctgaatctgaaatactttcctgggaaacccccaccctctcctcaggtgtgtgtcttgtgttcacaaggatgatactgggatcctggtatttgggggtttcatctgagagaccctcacacaaagaactttctggcactctgctgttctgatgtggaataatcctgaaagtgcgatgccagccacgccacatgtcacaatgagaacacagagagagaggggaaaagagagggtaagacaggtggtgggaagtggatggcatgtatcagtggctcacttgggatttaattcctgacgtcagtaagcttcaggagagctgagacctgcggccagctacaaactcttaaatcttccctctttccaagacagagctgtattagtccattttcacactgctataaagaactgcctgagactaggtaatttataaggaaaagaggtttaattgactcacagttgtgcatggctggggaggcctcaggaaatttacagtcatggtggaagggaaggggaagcaaggcacgtcttacatggaggcaggtgtgtgtgtgtgtgtgagagagagagagatagagaactttaaaaaccatcagatctcatgagaactcattcactatcaggagaacagcatgggggaatctgcccccatgatcaaatcacctcccaccaggtccctccgttgacacatgaggattacaattcaagatgagatttgagtggggacacagagcaaaaccatatcaagatccaaactcaccatctcaataagggaaaggctgggggcccctaaacttctgtcctcagaaggggacccctaaactcacttcacccttgggcttgaagtaaattctggaatgggactaagatgaatcaattaacgttcttcccctgggctttcttgaggggggatgccaaaactctgaaaaatcaagataaatattattgtaatggaatagtttacatgtcaaaaccaaagcaagaaaatccacaaataacaaaatgttaaatctttaaggacaggatctgtcgttgagattgatgcctctaatttcctgattgctaaaccaatcctattcttaaaagtactatgatgagaaccatggcttattaaaaaaacaaaaaacacccatcgtggtggctcatgcctgtaatcccagcactttgggaggctgaggcgggtggatcatgaggtcaggagttcgagaccagcctggccaagatggtgaaaccccatctgtactaaaaatacaaaaaaattagccgggcgtggtagtgggcacctgtaattccagctactcgggaggctgaggcagagaattgcttgaacctgggaggcagaatttgctgtgagccgagatcgtgtcactgcactccagcctgggtgacagagcgagactccgtctaaaaaccacaacaacaacaacaacaacaaaaacacaaaaaacaaccctaacgaactaatttatatcagaaacaaacctgtgatatattttctaaagcaactgaacaagattttcacaatattcaatcatctgaatagatactatgtctgagtcattgaggggaatgcccaactgagttaacaggaatgatcaaacccgaattcccaaggcaaacccttttggggttcataaatccagcccccagaaatcttgcaaattgccctctttgggtcgacgcctgcccatctgtcaactcgggatcctcactctttcctctgtcccaaaggaccctcctctgtgtcttgcaacacgttccagaagagaagggtatttctcaggtctgcagaaacccaaagaagaaaattcgtgttatgatctgaagggagatgaaaagcatattttagcagggcattgcaaatgcattccgtgctcatgacagaagcatccaaaatacctacattatttagaaagctgcaggagagggaaaaatgaatgcagaatatgtgaacgattcattttgttttttaaaaaatgcagccgagccagaaaaagcttcacaaatgatccaaagacaatataaaatctcttctgtttgcaaagtcaacacggtaaagagatgattaaacgaaagcaaacctgagacttaaccttaaaggaattgagcattttaattttttaaaaggtggaaaaaatgccataaaagcatgtctgaaggttaaggaaactgttattaaaatgagaattatgagctcggagctgttcgcagctctgtccctggagtgtgaaattagtgactgaaggcagatttcacaggcacttcgttggagcgtgttggtgtggcagtggatttgtgatggggcctcgccgccaagtcctgcccacttgcaagctgctgtcgttattcatgcacagcacagataatcatgaatgtctggagcattttgcatttatgttgaatgcagcctctctccttcccagccggagtgagtttcgggctgtgtgcacgggtgaagtgcaggggaggaagcagctgcaagaccagcattcccaccaaggccatattttctctttgaagaaaaaaatccttccatatggattacattcagcagaaatgttggaaaatatatagaaaataggaatatggtttaaattttaaaccttaaaatagctccaagggcaacaaggaattctctgggtctgggtttcaggtctgaaacaattgatgctaatgatgtccacattccccatcacaccgtgattttggaaagttggtttggggaagtttaacagaagagagaaaactcaggaaacagtgaattgggagaagttgttgcatttcctcattctctctccgtctgtctcgttctcatccacttagtcacacacggcaaccaagcaaaagtgtaaatattacttttcatgcatttatctaggcatagttaggcaagcagaattgagcaaggccccaggtaaagggaccctttgaagtaatagcacttttttggctgttttgttggtcaatttttgggtgcattatgcttttaagatagaacttaataccaaccattaaaaaaccacctccttttcaaaatgaatattctcccttgtatggcttctttggtgatggtaagatatttggcacctcccaagtgtggtttgaactttgaacactcttgttgaaaatgtgagaggaaataaaaatcagctcacagctctccaaagcatactgcaaattaactgtgtatcgggatgtttttcggaacaaataacagaaactcatatggcaattggcttaaacaattacaaaatatgttggttcatataatctagaggtgatccagcaatcccaagatgtcttcacggatcagaccctttccatctctgccctgctgttctgtgttgactttatcccaaggctggacttcctcctgggtgaagaagaaatcaggtaacctttgcaagcattctcagaagagcaagcagggagtttcctagaaaccacaagcgaacccatttttgaatcttcttgacctcagttgcatgatatgtgtgctcttgaccaaaaccctatcaatggaatgactgggatcacccttagaacagtgttgtagctaggatgggagcaggatgaactttcttgaatccctgggatgcagggaaaacaggattcctgaaaagtgaagaactgggtgtgtgtgtgtgtgtgtgtgtgtgtgtgtgtgtgtgtgtgtgtgtatggcattgaaattttgggtaggcagtcaacagtattcactacacctatcagattccaaaggtatcttggtcaccttgattagaactctaaatgtgtttaatgtgtgtatgtacgcatgttcacattgtgctgaattggttagaatttcaaatggatttggcattgttctgtatggacatggcttcctcttaaagttcctcaattgatccacagggattaaaaccattcaaaccatgggtaactttgggctggagggaatcaaatctctgttcttcttgggagcttcttggagcttctctgtagactggcttcccttgctttctggaagcctctgccctcacttcactctgtcttgcctatgatttgggctgagaatggcacagggaagcctcctcttcacatgaatttaagctccagaatctaccacttactggccatggaagtattgcccgatggctggactactcacctacatggagttgggggtaaggggtcagctgaatgcacacatcttgattccaccccctcagctgggcatgtgacgtaagcattatacacacctccaaattgctccaccttagctgagagcatgtctttcttaactttggaaaccctagagctgatagttgcatactggtcatttagtaataactcacttagtgaataaatgaatgaatttattgacccatgtggtctaggactagaatgtaaacttaatgagagcagcagtcatgtttgtttttcctcattacaaccccagtgcctagcacagtgtgtggcacccagtagacagctaatgaaagttatggaataaacaacctgcagggcagtcagaggatggaggttgagcacctggaatcaagtcagagagcagggttgaatccagacctcaccactttctggctttgtgaccctgggcaagtttcctaaggtctctatgcctacttttttcccacctgtaaactggggataataagaacaccagattagagaataattccggaagatttcaccagagaacacttgtaaggtacataacctatcgcatggcacgtggtaagtgccatagaattattcactattatcactttcttctccataacccagcttccatggctgtaaacttttctctgtcttgttcactgctgtgtcttcagtatgcagcacagcacctggcatatagtacatgctcagaaaatatttgttcaatgagtgaatggaattctggagacatacaaaatgaggatgttaaggattagaccaaataaaatccaccattctagaattctgtggattgaaattctaagagctactcaatgaatgtgttgagttgaaagtatttctttggttaaatggtaactctccccctcccccatttgtctgaatgcccagatgttgacgcactgggagaattttgggagggcacaaaacctgtacaggagccacttctttcactttcgggcaactctcctgagagaccaaaatctaccctacaaaatcctatatcaaccctttgctttgtcattccagttgcgataggcgggagagaaatgttccgttttaattctgtggaaggtaaagcaaagcaataccctgggatacttgtaacagtccaaaacattcctgaaataaaacattggttctcaagagtgcaggaaatcttccattttcttaacatgtgggaaatcatttaaaggcagccatcttgccgcttaattttgaacttccattagcctttaataagaagataatcagtcactgcagatcttgtcttccctacctccataggaaatagtcctcctgccattcagagagaaaaactatttattacatctcaactatgtacttgtcagacacctttctatgcactggggatgggaatgtgaaagtaaagctaattcttttttcgaagaccctcagaatcacacaaaagccaaggtcatgtgtaatgtgtggcagatgctgttggtaccctgcccgcctctcctaggtactcactgttcctataaataaatgccagtgacatctactgtgagcacctgcggctctccgcctaagaactttctttggttgttggagtgtgctcagcctgtgtgtggggcaggctggaggtgccagagagttaatgccccagggacagcccctaatcagtgatggaagtgagctggtggctcaaaatcccagtttctttgccctttgagtgggataattcaccatgttcttcacagccttcaacctgaactgcctattctagaacgtcgtgcctattaagtcaccttggatggtttcctttctttttcacatctcaatttcctattcccctactgttccttttatggctcccaaataaatgactttcactcaaatttgtcttcatgcctgcctctgagagaaccctacataagacaatcagtatggctcttcctactcaagggacgaaaatctcagctcaaggttgcttgaataaaaggattgcttgaatcatgctgtgattcacaggaaagcccgggggacatattggcttcaggtatggctagattgaagcacttaatcgtgtgaacactgagtttctctctaattctgaggttttctttctgttgtatttgtttctttctcaagttctattctgtggtcctaggaagtttcagtctcttcctttggttcaaaggaattgcctgagaattagcttcacattttgtcaaagtcttttccaatagctcacatagcaattctgagttttgctctaattttgatttcctatctattcattccttatgaatggattttcctttatgtcctttagcatacctataacagctactataaaatctttgctaatttgaacatatgagttatcttcagataagtctctattcttatttttttatgttgagtctttgtcatattttcctgcaattttgcattatatccagaatattgtgaccaatacagtaattcttgattccgttgttttcctgtgaagactgttgattttttgagcaagtgactaaagtggctgaactcaaattgaaaagatcttgcgttcagttactaaaggtaaaagaaaaaaaaatgaaaaggtttgtgtttcctggagtgggaaatagctcaaatttcagttcaattctgtggcaaccctagctgggctacttgtagtctgcctacacatatgtggtttagggaccagctagacatttgaaaagtttatacataaaatttggggctccctgtctctgatgtctctctgcatttgtaatttccctgctccattccagtggctatggtttcccagagcctggtcctctggttcttcaagtgggtgagatgactgatttttagttggagttttagttgtccctcttttgcagactgaaacctcctctcaggtgaaaatctgtccaagcatcaactcccctcccatatctgtctgcctttcttcattgtcctgtgctttcaggtcgttgtttttaaaattttgtccagagtttatagctgttgtatgtgagaggactcgcctcccagaggcttacttggccataaaagaagcataaggcctagtctcaagattcattctgattggaccagcttaggtcacatgactatacctggaccaatcactgtaatcagagtaatgatatataccaattggtgagggcttcattcttgaggccaagggacgggccacaccaggtcatgtgaactggaaattgggaaggtaaacatccacaaaagctaataacgttgaaagaaaagagaatggatactggtcaagagactacaaagtgctctggatgtgtttgcagatgttcagcatatattagcatttgtccagtgatggacgtctgaccactgctctcgtagggtctgagagaagacatctcagaagagggatcactcaagtagggcctggaagctcagatcaggagctgtcagtcaaggatcgaggacaaagcatgcagtctaggaaaaagcatgatattttctacctcaacctgtcagattccttttaaacatggctttacagctcacactcatgaatcttctttccacgtttttgcttcacctaagaccatgatatttgaaaaaaatagaaaagaaaggaataaataaacctctgaggcaggatgagtcagaatgacttcattgtctctcctctcagttccatatattgaaaagaggatgaacaacaccctttgcatttccagatgtggaatattttgctgtatcaatttgtgttctctcctctgtgatgacaactcttatgatttatgataaacaaattacaacttaatgtaccaggtaggattatctgatcccgattactgctgtgagtaatagtgctcccagtcacagacatctgaacagacgtgcatgtacttttctcccacgtggtagtctgggcgatagctcaaggctggcatgtgggcactagttgaccaagcacccagggacctgatttcttcattcgggtttccctgccaggtgtggcttctattctcaggaacagtacatggtccaagatggcagctccagctctagcctcagccccagacgtgttgccccccaagcaaccagaatgaaagaaggtatgaagtcaaaaaggctcaaagcatcaggtttcttttcaaggaacattccaagaagctgtcacacctcacttccacttacaccctattaactctgttaaattaaataagtaggaggtcattagcctgaggctttctctgtactttgagttcttccataaagctctgcaacctaacttagtatataaacaaactgaaacctaatttaggagtgtagattttttgtaacagatacccagatctcagccaatcaccagctgccaagtttcagccaatcagaaactgctgagcttcagccaatcagaagtagccaacaggtcagaccatgtccaaataaggcaaatgcctaggtgtaatcaatcaagttaattttctactttatttatatcttctgtctataaacacttgctctccaccttgctgagttgagccctcagaatgtcttcaggttctgagtgctgcctgattcttgaattgttctttgtccaaataacctctgttaaattaactttgtctacaggtttttttttttaatgccttcaaagccagggagagctgcagcatgttttttggatgacttcaatattaaaaaagattcctgaatactgcgtagtactgttggcgctattgcttccaccactatgactactactgggataatgattgttgtgctagatacacctctaagcacttaacacgttgaatcctcttaacagctccagcatgtagatactattattgttattccaagttacagaggaggaaatgggagcagggagaggataggtaacttgcccacagccatgcagctggtaagtgtcaaagaaaggattcaaacccaaatagtcttgttttagagagtacactctaaaacactacttgctataattactgcaaacactatctgattggaaattcctttgatttatttaggagttttgatccagtagtttttttcccccacaggtcttttaatttaattaatataaagtatattatgagtattttcaaatacacacgaagtataggagaaagtgtaagaaacttccatttatttacccattacccagctttaacatgcgtggtaaatctcatttcatctctatgtcaccttatactagtttattttcttttggattattttgaggcctagaccttgtatcatttttatcataatactttagtatgtgtctctaaaagcgaaagactccatattaaaacacaaatataataccagtatcttgcctacaaataataagcaataattcttttaatattatcaaatatctagtcaacgttcaaattttcctgattatctcataaacttttcttgagctactttttaaaataaagattcaatgaaggcccatactttgtttcttccatctgttgttagtctgtaactttcctaacatcctgtgtgtgtgtgtgtgtgtgtgtgtgtgtgtgtgtgtgtgtgtacatttatttcatgttctgatgaaaacttcgtgtcttataatggatccttcttcaaaagtttgggggaaaaaaacctgctctagagaatttgaacactgcttttttttttttttccatagccaattggattacttcccccttgcaaacttctctgactcagatgtcatgaaaatcctggcccaggagtcctgtctgactcacagggaccaggaaattctacccctctctaggggacaaggagggatttgtgtgattttagggagcagatgatgctgtggaaaatactacaggcctcaactcttcccctagttataaagtctgctgactccaaagtgtgccccatctgctcttcctttgattctaggggcagacataattacataaagtaggacattgatctttttgcatttttaaagccagagtcatgtctgggaaagccaagtctgccgtatctgtaataaccaccttaaaaatgcaggaaggagaagggacgtgcatggagttgaaaagtgtcgaatgcaaagcaagtcagtaattatggcacagagtgagggcagtaaatgtgcctgattatgcaaatccaggtggaatgtggatgccagtggtgttctcatctccagttaagagggtggctgtcagcacgagagtcctggactgagggagtaggagagaggggccaggccagaaggggcaggagccccggaagctggatgtggtcctgggtgggcacagcctcaagcagtgagggccctgcatccagggacagctaggtatggagggtgtgcaggggcccccagatggaaataaagccccaccagcatctggcaggccacccaggtgagtagactggggccccaggtaggaggcacctgaggctgggaagatgcttcccaaattgtgatctgcctgtccgtggtggctcatgaaatgagttagacagcaagaaaaatcttgctatctgatggttatgggtgtatttgaatgttatttcactgaaacacaggggactggtgatgggtgtgagctctgcagcttgaatgcctgggcttgaatcctgactctgccatggacttttcagctgcgtgactcagccctgctgtgcctcagtttcctcacctattattatatgcatatgcatataataatagacctacctccaagagctgtggggagaaatcaataatgagctaggaaagtgtctgaaatgtagcaagaagtcgatagataccagtggttattgttgttgttcagagaggtagttgagaatttagactctggagttggacaatagcgagtcaggtctcacctccctggttttctagctgtgaggccttggataacctctttgtgcctcattgtcatcatctgtaaaatggtgacaataataatatcttcctcatagggctgtggtaaagattagacaagcgaccgtatggaaagcccttagagctatggatggcccatggtaagtgctcagtcaatatgcacagccatcattagtattactagttcttagtagcaggctacattatacaaatgatccaacttttatagtccatttgaaaaaaaaacatgttaagtaatcgtagaggtattatccaggagtggcagagaaactgttcttatggtaggctagccctgaagtttgggacatagaaaagcaggcacatttgaagacctagctggtagttcatatcaaggatgtaggtaaaacatttgtctatgaaagcaccatgtctcagttatctagagccacataataaacaaccacaaactagtggttcaaaacaacaaacatttcattatctttcatggttctgtggggtaactgggctccgctgggcagttcttctggctgcttattttcagctggtgctgcaaccagagaaagggaggagctaagaagacacccagggttgtagccagagtaactggaatggtgacatttccgtttgctgaaatggggtagactgtgagaagaataattttggggcctgaggttgaacaagagttcagctttgttaagatcatgtttgaggagtccagtgggcagttggatatacaagtagagatctcaggaagaagttggggtaggactgaaatattttagaacgctcagcatagaatgagtatgtaaaggcttcagtcaggatgcgatcgcctggggagtaggaggcctaggaagacacagatgtggaaactgaagcaaaggggttcaaggaattgccttgtccacagactgttgtggaggaagctgcactttgagttcaggacgtctgggctctctcccaaatgatgaccgaaaggcagttgggccaggatgcctgaggatgtcggaaactcatgcgcttctgaaggctcttctcaactagcagcaaacccacagatgagctggtgtctctgtgttccaggccagggagaatgtcttcaaatacctcttattccttcctgggtggatatctaatctgatatgaaaatagagtccaggcgtggtggctcacacctgtaatcccagcactttgggaggccgaggtgggcagatcacctgaggtcaggagttcgagaccagcctggccaacaaggtgaaaccccgtctctactaaaaatacaaaaattagccaggcgtagtggcaggcgcctgtaatcccagctattcgggaggctgaggcaggagaatcgcttgaacccgggaggcggaggtgcagtgagccaagatcacaccactgattccagcctgcgtgacagagcgagactctgtctcaaaaaaaaaaaaaaaaaaaagaaaaatagaattccacttttccttaaacttttatgatgtacaccttatttatagagacaaatatgcctggcagaggctgggaggtgggtaagggcaaggagggcctggacaaagaggaggcccaagagcagtggggaagtgtgggggccctggcttccacctgcctgggtcccagtcctggccctgccacctctgggctgtggactttgggtgggccatctcacttctctgctcctacatttccccatctccatcctgagcataattaataatacctgaatcagatgtttgatgtgaagactgtattactttatgaatgatgtttcccaaacagtggcacatagaaggcatctttatgtgtattttaggagcattagcttacaaagcggggagccaagagacattgtccacagttggacaacgaaataaagatgttcaaatccttaaaatgaccaggataccccaaaatagaataatagtaactaatagtaactagaataacagaatagtagtaactaacatttattgtttactacatatcatacagtcttcaaattggtacttttgacattatggagtaggaactattattgtcccatttaatggatgtggaaacagagacacaatgaaatgcaacagctcctccaagtttctacagtagtaagtgacagagctgaccttcaaatctgtgcagtttaccttcacagagccatctttgctacttccaaagtaggcggtaaaaattatgctactgggaagagccctctgctaaatccttcgtatgttacagcagcaagccagcaaccgatttctacagctggccaaatgagagtgtggagcaactggaagtcccatacattgatggtgggaatgtgaaatgggataagccactttgaaaagtgttttggcaattaaaaaaaattaaacatgcatctctcctatcacccagcaattccactctgaggtatatctacaagagaaacaaaaacatgtcaacaagaatgttcataagcagctttatccataacagccccacactggaaattacccaaatgtctaccgacaggggaatgagtgactaagctgtagtcgattcacgccgtgaaatactactcggcaataagaaggaacacactactgatccacgcaacaccatggataagggctgttactcttgagatgtcttgctttcagaaatacggacatggttcagaaactatcaaaagtggttggccctggatgtgacggaaggtgagggggcaggggccaggaacggttgttttactcttccagcctttctgcacttctggtaatttgaaaaactgcatgctatttaatttcatcatgcttccaaggtctgtttctgctttttagccaattgactgccagctgaagtctagttaaataactggcagccccacttcttaggttcagtttggacacttagcgtccaacttggaggagatgaatatcaaatgcatgtaattacataacttggcccaaagtgaaggaaatgaattatctaggtgaccaggactgggtggctgtggtccaagagtggcggggcagaagaactcattcccgaggagggacgagttgggggcatctcacatgaaagtgaccttgagaataaagccccacatctgcaggtcacctgtgtcctctgagaatgtggccattagttttgacagcgcctcagccaggagcctataaatgaacgaaaaagactactagagaagggtgctgttttacataaattgaggattgtatgagaaaatagtttctcatgctgattggcaccgcagtctctggtgtattcaaaatgcaaatgaaaacaacctttgctgaacaggactctttgcatctggaatgcttcagacagtaaatccagaacttcaaagacaagagaaattaggggttggctgcccatattacataagatttatcatttttacaaagtagcagatcttggcatgtgatttgtttcacaaaaactctatttagacacctccttccgtcctcttataaggcccgcctgcagtagtcaacctggccatttcctgtgtcctgtccccccattgccatcccatacactccatggggacagggctcttctctgggtctgtcatcattttattcccactgctcagcacagggcttgccccgctttagaagcccaggatatatttcttgtgtgaacagtgttaaagaaaaaattattcccatgcttgttaaaataataaggaagactttactcaggacaactacaatagctgtcaagatgattgtaatagggaaaagattgagctcaattctgaatacaagaacacatttgggtttatagccaaggagcaggttgcaaggttgtggatggaaatttaccaaagagacatcaagattggagggattcttgctggacttgaccaagtgaggttctggctgacggcaggccagggtgaccagatatctagggtgggcgttgaggggatgctttctaaactgacttatcaggattcttgctgaaattgggctaggcaagcctggcaaggatggggccgaggtaaaggtctggttgagaagaaggcttagaggacctgattaacgtttggttaaggagagagtctttgtcaaaggctgaatgcaaggtttctttgtctcgaactagttctttaggttttcaagtgcatcattattaatattttaggtcgacattccagtaagacttgtcttttattgggtttctgcttgtggtttattttctttgttatgtgttgggttggggctcttcgtaagcaacaggaactgactcaggctgcagagtaaagcagtttcaactgcatttgatgttttggtcaccctacctaagatgcagcttctaagaggagagcacagattggccagtacgggacttgtcaccttgattggcaggtcctccagactgtatccaaggcggcaagctttgttcccccaaagagaattgggatgctgttactggagaaacagaaacaactgaggaaacagtggttctcaaccctaccagactaactcaacagccacctttatgacaaatattgtataaagcctccttacacttctgaaatgaaattcataaacaatatgacctacctatatacaaaattgaagaaatcagactattgtcctcgctataatgtcaaggagaaataaaaaggaatctaacttgtagaatattgcttataataacaataacaaaacaatagaattgcacaaaattaatgcatatatgtgcttggggacagatgtgctacaaggcataaaatacgagtgaaatatttgcttctaccattgatgaatatgtctggacttaaaaatgcaagataaccaaaagtcatcctgtctaagaagtacagaaaattaaaaggcagaggaggagtgaagaaaacacatttaatgtgcattaaaagatgcatcaaatgctttgtgttcctatggagttagatttgaggctcatttattataaatagagtttttgtctgcgggaatatccagaaagacatttaaaagtcatggaggatgcaagataattatttgttgtgtgggattgttttgcatgcgatggtagtgatagcgtcctgtgctcctgtctactaaatgccaggagccctcgtaaggaaaatatggggaaaattttgaagtttagtgtgtgtcttgactagctcatcaacccaggtgatctttgtcttcattgtctctaactagactattttctagttctttatagatacaagtctatttgtagcaaattcagagcaatgcaattcctgtccatagagatgtacattatgtctagtcgggttcaatgcactcccttcctccattatgaaataagcccgttttgcatctactaatcaaatgcatttcagcattcctaatagcctataaatgtgtctgctctttgaatttccttttgaattggttttaaaacctttctacttccctcatccattactgagttaaataaaactgttgacacatattcttttaatatttgtttgagagtcatgattttatctttaaaaattaggctttgataatttcaatcattgtggaaccaaaaattcacccctcataatttcaaaactccctagaaaacaatactatgcccactgtgagtcactgcatctcacacacacacacacacacacacacacacacacacacacacacacacacacacagagaaatgataaacctacagatactgaatttattttctcttctgtgtatcgtgtgacctggtagttgactgaatgctatatcgcccctgttttacaaatgttctactttggaattttagggtttgaaactggaagctcaagatgggcacctgcagatcacactttattcatagccatttttctttaaccaaaatcctcggctttttggctttcgtacgaggagaggaaaatcacagttccagagatgaccggacactcttcaacacttttatgaaagggaattacattttgtataattctaatcttctcagccatggttgtttctttgttgtggggtatttttaagcatcaaaaggaagaagaaggaaaaaatccagagaccacccccaagcctgaaatcctgttaaacctcacacaaaaccaaagccaacagaccttgacagaataagctcataaacgaacagagcacagtcttaggggtgagatcctgtgcggtccttcataagctcaattcctcccatctggacaacgggggacagagcaggtttcctattttccaggtattctggttggctacttgccacggaaagaaccattctttgatctttgggtttagtgctcgttttcatagctccggtccttttacaaggaaggggcagaaatcatcactcaaggtaggcagcagaacacgaaagaggcgtggatgttttttgtgccctgttggatgaaattagcatcctgacaaagaaagttcttgctaatagatcagggggtcacggtagggaggatgagatctctttcctaaaatacttataccctgatcaatgtaggacatatttccaatactgagaacagcttctaaagcatttttttctgaagggttttatgatattagaatactaataattgctagcaaatactcaaaaatactaaaaaatcccccaaagtgtggtgcgaatgcacgatggtgtgtgacccgtgcatcagctcccatgtgttgtgggtgtgcacctcccgtgctccccggtatgcctctgggaccacctgcttcccctcctggcctccttccctccagccaacaaccccggccccttattcttcctctaagaggccaaactcatgcccatcttggcttgtttctactctctgtttacacctctgcaatgctctgtccctgggagccaaatgacatactttccctccctgtgatgaattcaggtttcttctccaatgtcctctctctcaggaggccttcctgaccacctgtctaaagtaactccttggccaggtgcagtggctcatgcctggaatcccagcaatttcggaggctgaggtgggtggatcactagaggtcaggagttcaagaccagcctggccaacatggtgaaaccccgtctctactaaaaatacaagaattagccaggcgtggtggcgggcacctgtaatctcagcaacccaggaggctgaggcaggagaatcgcttgagcctgggaggcggggaggttacagtgagctgagatcacgccactgctctccagcctgggcaacatagtgagaatccatctcaaaataaataggcaagtaagtaagtagataaataaataactcctccatccctcttgatcctattatcccaccttatttttttcatagcacttttcatttgacgttgcaggtgcttctcacgatacaatgaggccacgtcctgacaaaaccactgtaagctgaaaatgtattaaatcaaacagttgttaactccagctgctccttgggttatgatggggttatgtcctgataaacccatcataagtagaaaatattgttaatttgaaaatgcatttaatacacctagtctaccaaatatcgtagcttacttatcctagcctaccttaaacatgctcagaacactttcacaccattgtaaagttgaaaaatcattaagtcaagccatcctaagttggggatcatctgtattgcatatctattttttaaagttggttattgtctttcttcccattagaaggtcaagtccaagagggtagggattgtgttttgttcacaacgctgttttgctccagtgcttgggacagaagatggtacatagtaggacctcaaccaatatttactgactgaatgtgagtctgcttttctttgaagcaccagcctagacctgcctccttcttgatcctcttaggatgcccatcagactcagttcctcttccctcagtggcctcatcgtatgtttgtggccaacacatgctttttgaggcctatggctgggaggctagatctaggaagacaacagaattcctgcctcccggagccgacattctcacaggggaaaatggatattaaacatgtggtttgtatctccatctagttcttaaatttccttctacctcattttatatttactttgatcatttgttcaaaaagcaatttctctgtgtgtgtttctcttaccatttgaaaaaactgggtgaagcactagggaaactgaactataatagagacggagggatcaatgtttgggctaaggatgggagtgggacaacaagggagaaatcagagaaggcttcacggaagaagtgacagaaatagaaggatgagtaagagttcaccagaagtgggactgagagggagaggcacctgggcggagggagtggtctgtgtaaaggtgtacaggccaaagagctgctattgatggaagagagcatcatttgaaataccctaaaactgatcaaactttctagatgataactcagcttctcatgtcccaatgcaacgcaatccaacctgatccaacccaaactgacccaatctgattcaatccaatctgatttgatccatccaatccaatcctggggtatcttttgagagctggccaagtgcaaagcattgtggaggatgcagagaggcacagagcacaccccttgccctcaaggcattctgggtctttccaggaaggctggtatttacaggcaaataagaggaaagaatctgatttgtgtttaaggcatcacaggacgatgggcaaacacacacggcttggagatttgtgcccaattcacttggtaagtgaaaagtagcaaaccttattagatagtggccaggtcatccatccattcattcattcattcactcactcacctgacaaggatgtattgagcacctacaccacgtacttggcgcattctaggtgtctgggagagggaggtaaacaggaacgatgagacccttgctctcatggggcttaccctgaaaattcaccaaaatataggtgaacagctgagtaaataagaccttttcagagcgtgactgtgctgtgaagaaagtacagcggggcagtggactagtggggtgtgggagcagcaggatgggtcccccccttcaatgcagtatctggggagaagcccctctgacctctattagggctgagacttgcatgtggaggacaaggtgggcatgtaaaggtctgccagagggcacagcgagttcaaggctgggaggtggggacagccacctgggtgtattttggggaacagaagggccagagaaactgtggggaaagtgacatggctttattctaactggagatgcaatgaaataaatttctcattttcaactcactgcttgcagggatccattcttcccctaactggaagactgtgatatgtagaaagcactgacaaggtttaatttaatttagattgttgaagcccatcaaattattccattcccaccccctgggcccttttctttcctgcccttgaatctcatcttccacttggtcctttgacagggatgactcgccttgtgacgcagagtccctaagccatccaatttcctgcgcattattaaaattgttaaaacacaaaatccaggtacagttgttatctctcttattgatccatacagaaaagaaacagccaagaaaaggaaaaaaaaaatcacgtgaccttggatccatatcagctcagcacagctgaacaaaggctggggaaattttctggttgatatgtgagatttcattcttggaacaatgatgcttccaaacaatgataccacccatggcttttgtatatggagggctcatagaggctgtctggtgctgaggggtcagggaaggaactgcttctgcacaggacattctttgtttcagcggcacttagtgagcacttggtgtgtaccgagcatggctctaagcacttcacaggtgtgatctcattgaatctgcctgacagcccttggagaagtgatgttattagctccatttcacagataggaaaactgaggcctggaatggtgaagtgtttcctgttcatcatagagtgagtaagagatggcacctggattaacagcagtctgtttcacagcccgtgctggtcagcccacctggttgactgatgcagctgggcgaccttggtccaggtgtttcacctccctgtgtctcaggtttcttctctggaaagtgaggacgatagtcacactttcccgatgaggctgttgagaggatcagatgggcgccaggagcctggcaagggctgcacagctacgagctgtcattgcatctgaaaacctgccattggaaaaaaaaaggcagatgatcttctgtgggagccacaaaaatcaggattccaagatgcccccacctctgcctatacacggggctgtagctccaacagtcacagttagttcactgagatcagcctcccagatatcacataggccgttctccgtggggggttaacagtctcctagtaagtgcttcacttgcggcttctctggagttgctggtgtgtgtgtgtatttgtgtgcttgtatgtgtacatgtgtgcgtgtgtatgtgtgtatatatgggtgtgtacgtgtgtgtgattgtgtttgtgcatgtgtgtgtgtacccgggttacagaaggggctctggggtcagatggcctgagatttaaccccactcttcagctactcattagcccacaacctcaggcaaatgacttaaccccgtggtgcttctgtgtcctccttcatgctgtcgtgactatcatagccccgacctatagggttgatgtgaagattagatgaattagtctgtatgaagctcttagaaggggccctggcacaggactggtgctggacacatgtcattaccacccatgatccccaggcgtctaccgcacaccagctctatgcaggaccctggggtgaatgccacatagaccccttcccctcaggcagcgccagcctgggtggagggggagtgttccagccccactggtaactagctgggtggcctgggccagcttcttcacctctctgtgccttcactcgcctccggaaagtggggacgatagtcacacttacccgaggatgacattgagaggattcaacaagcgccaggagcccagctagggctggttagctatgagctgccattcctatcattgtcatgtctctgtttgttctctgtccttggccgcttcactgttcctccagcaatctagatgcgttcctgcctggtggtcctgccgctccctctgcatggccctcacctcccctggatcttcatttagtgacttctggtcacacattgctcccttgggaggcctcccagccaggccatccaatggagctcttcatccaccactggccactctccagccaacagcagcaaactacagctgggggacaaatccagtctgctgcctgtttttgtcaataaagttttattgggatacaaccacttggatctgcctgcatatcatctatggctgccttcttgcttcaggggcttggttgactacttgcgacagagactatatagaccagaaagcccaaagcattttctatctgatccctctggctgcatggaggagatggggtggatgttggatgttgggtgaggttgtggggagaccttctgtccttgcacagcatagagaatgctgagggttcccagacactgggcctgcaggcagagagattatgtagagcaaagctgagtcttagaggccaggtaggccctgaccgttccaagggtgggtcacatttctggcccccagcattgttctctgagaaatggaagatttaatactctgggactcagataagggcccttctgcctctaaagtcttgcgtgtctgcccaaggtcatgctgcccatgacttcacagaaagttcgttggctcctgttctgttctgctatcccatttgatttccatcaaccctgagttgggttcccagaaacagactctgggatgaggatttgagagtaagaagtttatttgggaggtgattccagaaaaccctacaggggagtggggcagtgagatgggacagggggtgtgctatcacacaagtcccctgcttcacatccatcattggcagagggccgcatctggggcgtcagctcccagcacttcccaggggccaagagaagccctcagctagagcctggggcttgtggtcagatacctgcccagcaaggactcgctgtgtgtcgagggcatgtgggctacgccagcagctctcacaccatcacagcaacgattattttccaaaggcatttagttaagtgaattgcatgtctatgcctgtttccctgtctgattggggcctcatcacctgggccttcatggagggtgggcatcgacgaacactggctgagggcagcaggggtgtttctctccttcggtctctctgccttcacaggattccatgctgcccctgcccctgcttatatctgatcttataagcaggaccggatgtcatgattctaccactccttctgttcatttctagttctttttggttcagtagttgtgacagagacaaccttttcttcactgatttccccttttatacgtgcaaattgggagtgaccccatggtctccaaggctgtgtctgtcccagatttgtagcacacaaaactcttccaggcatagccacattcagcctggaaagctgaatgcattgaatgattcctctgggatccttcttcttcttctttttttttttttttttttttttttttgagatagagtcgtgctctgtcacccaggctggagtgcagtggtgcaatctcacctcactacaatctctgcttcctgggctcaagcgatcctcctacctcagcctcttgagtagctgggactacaggtacatgccaccacacccagctaattttttgtattttttttttttagagccatgttacctaggctagtcttgaactcctgaactcaagcaattcatctgcctcagccttccaaagtgctgggattacaggtgtgggccatcctgcccaacctccttctgttcatttctgaccaggcatggtgaccttgcctgggatagtgaatgagccaagacactgagcaagaaactcagacagcaacatctggttcaagatttacccctcatgggttgtgggagcttgggcagacacataagactttagaggcagaagggcccttatctgagtcccagagtctcaaatcttcaaattttcagacagggacgttggggtttggaaatgtgactcacccatggaacagtcagggtctacctggcctctaagactcagcttcactcgacataatctctgcctgcaggctcagtgtctgggaagcctcagcatcctctatgctgtgtgaggacagagcatctccccccaaacccacccaacatccaacacccaccccacatccaacacccccctcccatctcctccatgcagcagagcgatcattcattgcatcaaaactacacatcactcctgctgtctaaatgcttctatggcatcacctggccctaaaaataaagacagaagctcctgaatgtgctgtgtcagtggaattgggtttgattgtgagcagcagagacctagaatgatagaggcccaaataaagtataagaaacagagaaaaggcccccgtgcctgggcccagtcatcagggctgagtgtcaagaggacaatcagagaggtaggcaggagctgcatctcagggggctggtaggaggctggattgcactctgtgtgtgtgggatgaagtcataggaggattttgagcaggggagccacatgattttattgtctttaaaaaggtgtacttgtcttagtctccatattacatctgtttcaatgactattaggttaatatctcccctccccaacctctaccccaaatgaactgtccatggctgtaggaagcacagctatgtttttctcagcttctgtatgtatctgtgtatgtcctgcttctagcacattgcttggcctgtggctgatactcagtgaatatttataaaggagagaagggaggagaggaaaggtgagtctcgagccagggcaaccctttcttcactgatttccccttttgtacatgtaaattgggagcgaccccatgctctccagggctgtgtctgtcccagatttgtagcacataaaactcttccacatcgctgctgaggttgactgtatgttgagcaagaataagtaacgacgggagtcacgttgactgcaattcaaccatctaaaaagacaggggccttcagtcatgtgggtttggcaacatttgtcatcactgaggagagaggtaactagaggatgatttattgcaaccttttctggtgtgataagagccagttgcttaaagggggaaaacagatcatccatggctgcttgcttaaagagttctgtgagtatttgttcttcttttcagccatatagaaacttggaactactttcttgtgttcagcaaactttacatcttctgcagacttcaattactcagttatccgacccactggcttactctggaagggctaggtccaatggctctggttgttctaatcctgtgtacccatagacattcattttgaactggaatcttgtaactttaagaaacagcagcctcattcaatcatttctcaggatggcccattagtgggaggagctgcatccaggtccacaggatatactgacaggggatatgtatcagacgtgagagtcccatattggtattttgggtagtagatgctatagtgttggtacccagaggtattttcatgtgaacagctctgtggtaagatttggaccaagttcctggctatgtaactttaagtctaattatctagcccttctgggtagatctcctagttacctgctatgttttagcaagtttctgcttaaatttactggacagagttctgttgtttgcaactaaagccctgactcatacatggtacaggtgtgtgaagctgcctacggagtaccagagaggaagatgggaataaaagggggcacatgtacttggacttaactgggaccctggaaccaggaagctggcacacgaggtgggctatctgcaattgatcatacacatttccttttatttagtcattgagcaaatatctattgtgcacaaactatcccaggcgctgtgctaggcactgggggtaaagtactgagcaagacaaaggtcctgttctcactgagcttccattctggttggagagatagcaagagatggaaaatgaataaataaggtattttcagattgtgataagtgctttgaagaatggtttgataaaaagcgatgactgtggaaggctgctttagccagggtggtcaggggagggttctgaggaagccaaccttggggatgtggaggagccagccatgccaggtgctggggagcacgtgtcccggtgggagaagcaacagcccggagcaagaaaggtctgcatgttaaaggaacactaagggccagattgtgcagggcctctcgggcgcagtaaggagtttgggttttatttcactacagtagggggtcattggtgaaatttaagcaatggagtgacatcacgatgtgaatttgtgaaagcagagtttgagcctgtgggggtggcagggagcaggggcacctaacacgagtggagagctgctatggagtggatgtttgtcccctccaaacctcgtgctgcaatttgattcccactgttggaagtggggcctaatggggggtgtttgagtcatggtggcagatccctcatgaatagattaatgtgctcccttgtgggtgagggagttctcactctgttagttcccatgagagctggttgttaaaaagagcctggaacctccccatcttgttcttggttcctctctcgctgtgtgatctctgcacacaccagctccccttcaccttccaccatgagtggaagcagctcgaggccctgatcagatgcagatgtccaatcttgaaccttccagccatcagaatcatgagccaaatattttttctttataaattatgcagattcaggtatgcttttatagcaacacaaaacagactaaaacaggagctgtttagagacctagcacccagggtttttactggggcaggtcccatgggcaccctctgcttagcacgcaccaggattccacacacatggaatgaaagtagatgcccagcctaaaccacattgtttgcagcaaggaggctattgtaattttccgactaagagataatgagggcttggataaacgtgggggtgatagagaacagaaaagtgagtggattaagaatctactttggaggtagcgctgtcagaaaatgctgatggattgggtgtggggtgtgagagaaagtgagtgccagacttagccaaatgggcacagattatcatgggagaatccagcaccatcattaagcactttagagttcaagaaatgctgcttcatacataccctctctcacttaaccatgggcaattcacagtagaaaggatctcaggggacatctagtgtaactgtgtactttgacaggtgaggaaactgagactcagggaggggaagtatttttttcaagattaaacagagagttcattgcagacaccagcttggaatctgtgttctttgatttccaagtaagtgatctttcaatatgccatttttatgggaggattggaaatattataaacaatagaatgttaaagctggaaaggatcttgtgctggttcttaagctactgtttctcatccccaaactcaaccttttaaatttcattctataatgctgaacctgagactttacatttattcttcatcaagtttgtttcttgctgggttccatccacttgggatagcagcctgggcccaatcaggggataaaaaccacacagtgatttaaacagagaaaatgttacgtaagtaaatattaaactatgataaaagaataactgtagaatattttaaaaagtatatatggctccctaaggctaagagaatgaaccctaggaaggacaagcttggaaaagggccccttcctatggatggggtttagagcttcttgtagaaggtcatttgctgacccctggcttagcttattggtatacaggaagagcacctaacacagtcactaatattctaaagtcatcaatcccttctctccatctccactgttgccattttggtccaagccatcatcatctctcaactgactattgcagtagtctcctgactaggctcttggtttctgtcttgaccctgtattaggtcaggtttcctagaagcagagcctatgacagatggcttatgcatgtgacttattgagaagctactcctgagagaagggagtgagggtgcagaataggtcaggaaaaaaaagctaagcaaggaaggagagtaacttcagcctggtcccatggaaagcccgggagcatgaactgtaccccagaggtcccagtctgaggcagggggctggcatttgcatctccatgctagtcattggctatgggctgccctaggatgagcatgggggttgcagcttattggacaaggaagttctcatgtggcctagggcagtactctggggagggggacacctgtgagccattttcagacaccactcaaaacggctggggcaggccgggcgcggtggctcatgcctgtaatcccagcactttgggaggccgaggcaggaggatcacctgaagtcaggagttcaagaccagcctggccaacaaggtgaaaccccgtctctattaaaaattcaaaaaattagctgggcatggtggcgggtacttgtaatcccagatacttgggagtcggaggcaggagaatcacttgaacctgggaggggcggaggttgcagtgagctgagattgtgccattgcactccagcctgggcaacaagagcaagactctgtctcaaaacaaaaaaccaacatagttgcacatgctcagtaagggggatccacgcaagggtctgatagcatccacacccgctccaaccgtctattaatagacagtggtcaaggtggtcctcctcttcaagttcaggttcaggttccaagacagaatgggtcagtcttgtaatggggactgtgagatttgctgggctgctgtaggatctgccaagggacattagaagaaaggcaggaaaccacactggggttagagtcccacagaattttatttcagctctggccctttctggctgtgaggtcttgggtgagtgtcttctctctctggatgcatttcatcacctaaacatgggacacccacacctgcccaagggattagctctgggatcatcctctgaagcccaccactgctgctgctgcttcatgcattggcactaattttgaatgccttgttggatgttcacataggttaaaaagctgcttgaaatgatctgagcccagaactgaaatccattttacatagaaataatttttattttattttattttttttactgttttaaactgagttttaccacactgttcccatggtgtaaactacgggaagattgtactctgttcttttcaggatttattcaatgttgctcacctgtttgaaaaaaatcaccttaccaatggcagagcctcttgtggtgtctgagttgcccagaacagtacagctgtagtcagtccgcatctgtgacttcgttcactgtgattctgcatccaagttcaagcatctgatgacataattacacggtctaccttagtaatgccaggtgtattagtcttctcaggctgctatgaagaaacacccgagactgggtaatttataaaggaaagaggcttaactgactcacagctctgcagggctggggatgcctcaggaaacttacaatcaaggcggaaggggaagcaggcttgtcctccttcacatggtggcagcaaggagaagtgcagagtgaagtgggggaaaagccccttataaaaccatcagattatcctgagaactcatttactgtcacgagaaaagtatggaggtaaccacccccgtgattcagtgacctccccccagttcccttccatgacacgtggatattatgggagctacagttcaacgtgagatttaggtggggacacagccaaaccatatcactagggcacttacatgttgaactatgttttgttttattataaattcctttctttttctctttatatccctctggggaaattacattgtttaagaaaatgcctgtagctaggttatattttctatgaatttcatttcagttgagtaaagggaaagtgataaagtatttgtgttaaaagcctggcattgactctgacagagtcgagaatcacacatctacaaagaattagcaacatcttctctttccataggaaacccatagcctcactgagagacaccttggagctctttgttagtttgagccacattttacaaggaaggactcttttctgtcctctcccaactgctatcctttgctaggactccttaagagggagtattttccctcttaaggagtctgctggggacctgtgtaatcatttagcccacatcctgggccatgtcagctctcctggaattgtccctactagcgttgagtgtggctgtcttactcccctttgctggaggaacagacctggacttctgccaaactgaggtccctgcctggtgagtaagtaatttgtttcctccataggagatggagcgacaatcaagaaacaaacaaacacattttttttttaaaaggcataaaagcttagtcatgcaaatcaaggcagaggagagagggtaaagaaaatggccttattcatattctgcaacttcagcacgccctggcccatgggccgatttctattaaaacactcagcctagagcagccaacactccggctcattaataaaggtttgtcccaagtggagtaaacaccacccgttcccaggacacccagaagcagaaaattaaccagaggtgaactgggtcattagctgctgcacaatatgggtcatcctagattaatttagttcccttcaactggaggctcaaagagagtgaccggttctcatagcggggaacagtgacttagcagcgtgttgaggtctcttggataccaggccaggagctgccattatgattcatggcgcctctgacatcactcagtggttttgtgatgcaaagttcacatgtctgagcacacataagggactctgtgaatatgtgtgtatttgttgtgtgcatgcccgcagaatgggatacagagactcactctattcatcagggatttgttttaatcaggtatggtaagacccccagacacagaaagtactgtcatccgggaagacattcattacattctaggtcccgagaaacgggagacatggcatgctctgcggggccgcacggggaaccctgggaacccgggaaccgtgctctgcggtccgcacggggaacccgggaaccgtgctctgcagggccacatggggaacactgggaacccgggaactgtgctctgcggggccacacggggaacctaggaacccgggaacacgggaaccgtgctctgcagggccacatggggaacctggggaaccgtgctctgcagggccacacggggaacccggggaaccgtgctctgcagggccacacggggaacccggggaaccgtgctctgcagggccacacggggaacctgggaacccgggaaccgtgctctgcagggccacatggggaaccctgggaacccgggaaccgtgctttgcaggaccacatggggaacccgggaacccgggaaccgtgctctgcagggccacatggggaaccctgggaacccgggaaccgtgctctgcagggccacatggggaacgcttcctttcaagaggaagagggaggaagtgagacatgagcaagagactttattgaggaatgaatggataggcagtcaccaggctcagggttgtgagtgtgagtcacttcagcaggctctgggacataggggctgttcctagttgtctggtacctggccctggagagggagagcccaataaaagaggtggttggggcgtgtgggctcttgatttgtttttcatttgcaagacatgctccagatgagttgtttcctgtctcttaggaattggcaggcatgggaagagcacgctgtccagggtcggcaaggcctggaaatgtcagagcatcagaatactgaaaataaaagacatggtcagtactcatacatagacatgacacacacatatacacacatacgcagactcacacatgtcaacagctgaatgaaaaatgtctttcattcctggaagcaggagtcatatcactttctccaaagcatgtctttttctatgcaatggtgtgctttaggtgcaagaacactcgagaagcggcaaagataaagttaaacaaatccaagtgttataattctgcattatgcatatgttttgacttttcatcttttattcagagagtaagataaccaaatagagtaaaggaagcccagccaaccagctcagtttcatgtgggcagaaccagcaggaaattgaaaggggagagaagccccttgccaaagccgcctccacttgcactgggaagcccaccacaggccaccacctgggctgggagatttgtcagcaggcgttggcctgtgacagtcacacttcctgctcctcagtctgagatgccccaaccagatggcggaggcccgatggggaaggagcagcctccacggaggcccgcctggttttccagccttggacttgcagccgggacatgagggctccctcctactctcccacccctcctgctggtgaagcaagcccctcctactcagaagggagctttctctgccctggaagatgcttggaaacttggcttccagacgtgcaggcgccaggggcctgtccactcctcctcccccttctcctggactcactgaccttccttctgtgccacaaacagccaggttcattcccaacccagggaccctgtgtgactgaccattctcctcctggatgctgtccccagccctgtgcatggctgccccttctcacctttcagggctctgccaggtgccacctcctgggtgagcacttccctggccaccctgtccccaggagccctctccaccaaggcacttcctagcatctcaccccatttcctcttctcaagatccctcatcaccatctgaaatgaatttgagcatgtgttgacttggggaacatatctccccctccttacctgtgtgtgagctccaaggaaaatcagtgtccgacctgacttacgaacctgtgtccccagagcctacagcgatacccagcccagaggtgctggctgcacatgatgctgatgactcctagggtgagcctggcatctgagtcctgggttcaagtcctgattcagctgttcccaggcacctgactttgggagagatgcctcctctctgggtcaagtttttttcctttgtggcatgaacctatattccaatatccatcagtcacgactgctggggctcaaagaccaaggtgacatatgtcaaggtgcttggccaactcagagagttgtgcaaagagaaatgaccacgttaagttgctggcccacgcctgggtagaagtcagggaatgggctaaggaagagcatggtgatggcccgcctggcggaagtctgcagtgtgtgggtgtgtgtgtgcggatgtgtttgtgcatgcgtgttattaatgttgtttaattgccattcaggctccataaatagtagctaattcttcctatgtgccgagtatatacactcacttaattcttgcaacagccctgagtggtaggcactgctgttaccacatcatccccattctgcaaataagggaactgaggcaagggagaagaaatgacacaatctcctggaccctcttgatgccattgtggacaacaggccgcctgaactcacgtttccaggctctacttggccatttctgtgactctaatttccccagtcaaagcttaaattcatcacgctggtgtcccttgaggataaaaaagtgattaattttctgcagctcacttctctttctaggttaaatctattttggtggcgaggctggggacactgggaatatgatactgatcaatctagaatgtgtggaggagtggacagcagtttttaatcagacaagaccttcaaccccggcacagaccatcaattggcaggttctcctgggacatggacgtggtgcatggggctgcgttcacctgtggtggggacatgtcaactcgttctggggtttcagggctccacttgaacagaaccagttctcgtgacactgtaggcagaagagagcagcacatgtcacatggggctggggctgaggtcttctgaacaccctgaaggggcatctctgggtttcacctacctggatagtttctctctgttttcctagttcttagcgggcttcccttgtgggaaacaaccttcctccactatggtttttttttgttttttgttttttgtttttgagacagggtcttactctgtcacccaggctggagtgcagtggctagatcagggctcactgtagcctcgacctcccaggatcaagcgatcctcccaccccagcctccctagtaactgggattacaagtgtgcaccaccatgcccagctaatttgggtttcgccatgttacccaggctggtctcaaactcctgggctcaaacaactcacccacctctgcctcccaaagtgctgggattacaggcatgagtcactgtgcctggtgcccccttccccaactcttaatcccccaactccccagctccaagattggcaagtgacccagacccagccaatcaaacatactctgtgatggcatcaggaggtgggttcgtgagcccagcttgtctgatctgagtcagtccctggacctctgctggggaattggggaagaggcttctcttttctactgaccttgctgggctgatgggaggatcaggatctgctggggcatctttgccacctcatgagaactgtgtgacccagaagggagcccacccaggaggacgccagcctgagaaatggaagagaacccttcctgatgatgtcattttgcaccaagatccagctgtgcctgtagtcaaatactgccgggacattaagtttctggagtgaagatattcatgttttcactcatttaagtttgagtgggtattctgtcctttgtgatcaagagtgctgcctgatagaggttgcagtgagccgagatcgtgccactgcactccactccagcctggcgacagagagagtctctgtctcaaaaaaaaaaaaaaagtgctgcccgatagatgacagttccccctttttgtctcagtgacttttagagcttttggaggtctcctgttgggggccctaggctgtagggaggagattcatatttgtcctgtattcttgggaaacctttgagctaagattggactgaaatggcctcaggtgctctaatcaaattgagacctggtccaatccctgtgggcccctaaaccaaaggtgaataaggtgcctgcctagcaggaggttgtgacctccaggctgatggtggggtgagagctgggagtctggatggagcagatgtaggcagacaacaggatgagatttgaaggccacagctaagaatgacattgaagatcaagacctgtgctgtcctccatggcagtcactgggcacctggggttatttcagtttatatcaatgaaaactaaatagctttaaaaattcagttcctcagtcacgctagccacattttgagtgctccatagtcacatgtggctagcggctgctatattggacagtgcagacacagaatattttcaccatgtgcagaaagttgtactcaacaacacgagacagacatataaggttttgagtccagaaaacatcaagttggagagaggcagtagcaagaaaaaaagagcaacaataagggggactgtgaccaagaggtccccactcattcattccatccttccttcattcatctcttcacctcacattgattgagctcctatcaggcaccctctatgactgcaggctccagggaaacacaagagaattacacagatgtagcctcagaccacacagagctcacatttagtctgaggagtcagaccctaagggaggtaaataagtcactaaacaagacaattccagaaaataataaatgccaacatgaaaagagagcaggtaataggacacagcgtctttggtgggaggatcaggcctcaagtttggggagacgtgtcatctttgggcagctaaaaactacagggctcagaaaacctcagacatacagaaaggagaggaatgcactgctctatagcccactccctggaaggctgggaagccctggtccagggaaagcacagggttctaggaattgggaacgggacccaaccacaaggacaggaagtggacaggggcctccaggaagcagagaagaaacgaagcacagaagtggccatggggccatcatggagtctgtttcacggacagaaacacaaaggggctgttaggaacagccacctctggccagccccgcctgtgattgtgacctgacaactcgtggtttgtgaaggttgtttgtttcagaggcatttcgcctctctgcttttggaacctccacgagtggacttttgtcttggggctcacagtattttacccccttcagggaggtggctggttgtagtttagcaaaacagccactgacatcgctgctccttcagcctctgcagacagagctgcaagatcctcgaggcctttttaatccccagaaacaaggttcgcaggaggccagagcctttggtggtggggagcggagtcagcagggggaggggagaggcccttcggagagactgagccgccaggccatcgagggaacctgggccagggatgaggcacttcagccctcggagcagctgcgacagcagagtctgacctcccagcaaggggctctggctgcgggtttgttttctttgagcaaaatctcagaaacaaagatgcctgtgatgacctctgcacgtaggaactttccatttctgcattacgcagggcatatgtgtgtcatttaggtgttaaaacagaccaaaatgtgttctcccgcccagaagcaagcaaagccaaccccagctgcagttccctgacagtccagtgaattcagccaaaggaaatggccccacatggaggtgggtgaggcccagggaggacgactgtggtgggaaactcagcaggcggaaatgttctcttggtttctgggcgggctggaggtttcccaagggccggtgaagtttcagccctaatagctgcaggattctctcagggcaagtgacagaagacctgatgactccggtggctcagcggagagtgcattaataggcttgaccacttctgctcgatcttcaggcaagctgggtctgacccctggacactgtcccctggagcccctggcctccacgtgtccacccactgccatggtcatggctcctcagcaggaggaggcccagcagcctccaggtgcccctgcctggtgctagctgcccaccgaagctctagcctcacactctcaggttcaaatccagcgacaagagcggatcccacaaaggccacgagagtcaccctaaacggtcagcttaggtccttcgttcactgagcccatcgctgtccagggcaagtggtgctggctgggctaggtccagctcccgtgtccaccctgggacctgaggttcagggtcagctcaccctagacacatggatcgagtggggagggtgaatcctcaaatgctaatcaggttctgttgtacagaaggggaagcggaggcaggaggatgcagcaagacctgttccctcctctaacggcactcataggacagcccagccacacattcaaagaatcttgaaggaataggatggttggtatggttggtgtggaagaaggttcataaattctggatttagctttgtgggattcagctgacctgaaatttatacctgtgcaggtaggtggttgctgggtagggtgaccactactgtctctctccatcacccagggctgttttcagctcaaagccacagaagcccaggcatggtggcatctccgggggaagttgccttattccagattcacaggtccggggcgaaggggccaggcagggcaggtgtggggcggcaggatatcgccctgggcctggctccttctgcctttctgccaccatcttcagcggtgccattacctcgaggccttctgtggttgctggagctgccacgctcggcctcctgtctgcctccagatgggagaggaggaaggaggaggtgagagcaggaaagagcttacataaaagaccacattttcccagaatccccagcagctgcctgttctccccctccactgggctagagctgtgtcacacaggctgagcggccaggaagctgggcaccatccagggagtgtgtgatcgtcggggtcctgttggtaagaaaagggcatgtgggtagacatctggagtgcctgtcatggtccaattaactggctaaagggattgtgggtgtgcagctgttttcaatcaaaagtacgtaattcacatcttcccaaacacagattcctgcttttgagtaatgaaggtgaccaaaccacatgaccctgtctgcaaagattccacctggactcccagttcctccaaggaaccgtcatgtggttcaaatccaatgaaattctctaaatctccaccctcctcagggtgcagagttggctgcttctctgtgccccctgctgatcacggcaacccctgggtgcctcggcctgcgaagccccagctgtcctccgtctgcagacaagccgaggtatgaaagcctcctcgctggcccaggagcctgtcattgtcctccagcagctctagcctggatgcggtcccagagataaatcatatctctttaaaaagccacagtggcccattatttctgcttgaaaatacccctggctctctgctggtgagctggttgacaggccccggctgttgtgctcagtgctgcaaagagtcacgtcagtctgtcgacttgtgtagtgagcaagctggtagcttcagatggtatgcacatgaaatcccgtcctggcatccaggacttggctgggggttgcagagagaaccacatctgcaaaagagttggtattttacagtcccagcctcacgtccttgtgaaatgccctgttcatactgggctacaggggcgggagcaaaaatgatacaatgacaattcctgggctgtgttctgcaatattctacaacacttccacaagaaaactccaatctttaaaaatagactgagcacaattaaacaatcactatagatatttcttttcttttttttttttttgagatggagtctcactctgtcgcccaggctggagtgcagtggcgcgatctctgctcactgcaagctccgcctcccgggttcacgccattctcctgcctcagccacccgagtagctgggactacaggcgcccaccaccacgcccggctaatttttttgtatttttagtagagacggggtttcactgtgttagccaggatggtctcgatctcctgacctcatgatccacccgcctcggcctcccaaagtgctgggattacaggcgtgagccgccgcgcccggcccactatagatatttcaaccagaggaatatagtgaatcatgatctacccatcacccaggttcaacagctctcagggtttgcccccttccttccagctctttcccctctttctgccaaattattttaaagcaaatcccagacctcaagtggacattttctaacaaagttgcaatatcctaaacatctccgatgttcaaattcccccaggtgttgctcagatatttttttctggttgcttttccagaaattcaacaaggaccacacggcatttggttgttaagtttctaacttctctttggttgacagtgatcccctctccttcattttacttttaatgccactgcttgttgaattcctgggagcagttgctctgtgggatgccccacatccaggatttgtcagtctgctgcctcatggtgtcatttcaattccttctgcagatggatgccgctggacatccttgccaaggtgtgtcagtttcaattaaacccagaatggggtgttggagctcaaaggagccattgtcaagccattgcctgagcaaaggaaggtgtttttttttttttttcttcctgtcgcccaggctggagtgcagtggtatgatctcggctcactgcaacctctgcctcctgggttcaagcaattctcctgcctcagccttttgagtagctgggattacaggcatgtgccaccatgctcagctaatttttgtatttttttagtagagatggggtttcaccatgttggtcaggctggtctcaaactcctgacctcgtgatttgcctgccgtggcctcccaaagtgctgggattgcaggtgtgagccaccgtgcctggcctgtgttttaagatgatttcctggattcttgttgaactaccaaggcaggtgtttgctcccaggcttcaccatcaaattccctaacggctgtgttctgggttgagtcactttaatgagctgccctgccgttcccaggtgagatgtcaattagaatttgcaatcccaataccagggccacgttctcaccacctgaagaaaccctaacagtcgagacagaatgaatgaaggacagatcaatgggctgggtctgtacaagcacacccatagggcaacccaagggcacgttattttggtctgagttatctcctgagtcatggacatgagtctgggaaggtcaaggttcgcctgttatcgttatggaaagacactgaccttatgtgctgggctgtgccgtgggcgccttcttattacatcctcagaacagcctcaggatggctcatgattccctcaatcacagatgaggacctgaggctcaggaaagatacatttgcatcttgtaggtctgggttcagcctggacccacggtttccatgcttgccctgacccttcattccctccattccctcccagcagccagtcagtggctgtccagacatgtgcaccagctgtgctgcacctccaccataaaaactcctccaatcacttcccactgctccccatgtgaaccccaagggggctcaccctgtcccaggaggttctgcctgatccacaccccccaccccttcctgcatccctgcaacctgctctccctacgtcctcagtcctggcgtcctctctgttccctggacttgtccagcccagtcctacctccaggccttggcacctgctgtgcccttgacctggcgtgatctcctgatggccgttactgggctggaaacttctcagtgctcagcttgagctcaaagcccacctcttcagagaggctgtccccatccactgtggcctttcttccctttgctctttcaattcccagtttatttcctgtagagcagtttcaccctcttcaccaatcttgtttatttccttgtttattgtgcctcctttaccagaacgttcaccctctgagggcctgggccaggtctgtctgttcacagctctagtgctcagagaagtcactgcataaataaacaaatactttgctcagaaaattgtggatatgtaaatgaaataggtctgaataaatgaattaaatacaaagcatatgtgagtcatctttcccaagtagtcatatcataatgttaacaacaacaacaaaacaaggaatggggggagaatagaatgcctgcctgggggaagctgggctgtgtccctggacttccattccagcaggaagaagtgaaaacagactccaaggatttccaccggacagtggcatggccggacactgtttctatgtctggtcaatggagcagtgccccatgttatggctggcacggtgctgcctgccctcctgggggcatgacgaccacgtactggccctcaggacacgggaaactttggctgtttattctatttatttatttatttgtttatttatttatttttgagatagagtttcactcactcttttgcccaggctggaatgcagtggcgtgatctcagctcaccacaacctccagttcctgggttcaagtgattctcatggtgcagacttccaagtagctgggattacaggcctgcaccaccacacctggctaatttttgtgtttttagtagagatggggtttcaccatgttgcttagactggtctcaaactcctggcctcaagtgatcctcctgcctcggcctcccaaagtgctgggattacaggcatgagccaccgcgcctgccccccttgcctgtttatctcctttattattaaattccaaagagctttggatgaatctctgttttttaattctctgtctatcccagaggatgttttcaggcctgatggagtcactgagggaccctgatgagggctctgagtatccctggatgggaaggagacctcttcatccccaggcacagggaggccagcctgtgcagtattttcctctcctgcatttcaatccagctaaaggcatccttcacttcctgcttcacttcaggggtccccatctctgaagccagattcacctgaggcagcttcttccttgtgacctgacatcgcttttatgatgtttttattccagaaccacctgagagaggaaagagaactggttataaaaaggaactgcttctcttaatgactcttaaactccagagcgacctgcccaagggcagggagcagtggggcccgggggggtttctgaaagcaggggccatccatcacctggccccgcctctggctatgtgctgccttctgcagacctcatcactgctgtgctctgtggcatttaatcaatggcctttctaggggttctgagtgatgctgtctcttgtcagatgagaatccacctgcagctgcctctggaaggagtgttccaaaagaggggggtcccagcttctccctctgctgggaggggggaggtcacaggagatgctttggcccctgggcagcccttggggttcctgaaactccacaggggcagtgacaacatggaacatgctgcggaccaggctcctccaggctcagccccagaggtgggacagaagagatgcccagagctctgggcccctgtgagacccagctcccttgtccgcttacagccgtggctctgccatcacctacctggaacctggcagcctgttctcatctcccctctatccctggtcatgtcagcagccaagaggcccaggacccaagtcctccctcatccccactccaatctcccccagctctgaggcatgaggaaccccccaactcttcctgatccccttgcccccctcctactccctgagcctggggtccccttactatcctccctcccttcttttccccacagcatggctacccttgcacacgctcggtttcttgctcatttatttatctgagttctagaacgcatgctctgggcagcaagagcttttgtctgcagatttttatctcatgtaaaacaggccatggctctggagagggagaagtgccatggctggccactggagaagtggctcagggccagaggcacctgcgttgggggaacagtgaaggctgtggggacgggagaccagagctcaagtgctgcctgcctttaactttctggacaggccatgggagaggctaggcggggctccgtttccaagtgtggcgaggaagtcacttgtcaccagggttccctgcaattgagctgcccattaatgcataaggatgtcagctcctgcaagcctgtgaaataagtgccaggccagggctttgaactcctgagcagcaaggtgatttgtatgtgcagagaccactcacgaggaggcccttcaatacaagtgtccccctataatccgggtttctctccagtttcagttcctgagcaggtaagccaatttcaaaataatttttccataaggtgattatgaggcatcggtgccatggaggtgtggctgacacctctgccctggttgcatcctgcatccctgaagctctgtgctgtgactcagtgaggtaattgtctctgtacccccatcactacccagtggatgcagccaggggcatggttttctcccttagtttacaatgagattaaaggggacgttcaacactcctgactttaaagagacagatatatgcttttctttttctttttttccttttttctcttttcctgttcctccttcttccctgtctctggaaatctctacataaaagggtgctcactaaggtgctattttctttttctttttcttttttcttttcttcttctttttttttttttttgaaacagagtttcactcttgttgcccaggctagagtgtaatggtgcaaacttggctcactgcaacttccgcctcccggattcaagagagtctcctgcctcagtaaggtgctattttctaacagcaaaatgctgggaacgatcaagatggggaaatgggagaagaaagcacgatataatgattcagtagactattacacagacattcagaatagctccatgtagaccaggaagtagtatgaactcaagtgaaaactgtaaaacagcatgaaatgcattttgttaagtaagaaatagtataatgtgataagaggtacaccaatcaggaggctaagttgaggccctgctgtgcacctaacggcaaggacgtgcttgaagacaatgcttctcacacgttaatgtgctcacaaaccacctggggggtttgttaaaattgagatttctattcagtaggacctggatgggccctgaaattccgtaatttttagcaatcatctaggtgatggctgctggtttgcagaccacacttcaagaagcaagaccttaataatatattttgactttgaaccttcataataatccttaaaactgagtaaaactggttcagagaaggtcaatgacctccccagatagtggcctctcaggtaagtgacactgtcatgtgagtgacgtcctcaggtgagtgatgtccccggactcacacggcagggacatggtggagtcaggatttgaacacagatacccaattccaaagctcctagtctcaaacacattggctgtagctgcaactacatgagtgatttttctttttctgtaaagtctgtttttcatcgtctcattaattaaaaattgattataagattgtaaaaaattaatgagatgttgtcccctccaataatctctgagggggatgatgaaaatcactttttttttgagacagagtcttgctccgtcgcccaggctggagtgcagtggcgtgatctcagctcactgcaacctccgcctcctaggttcaagcgattctcctgcctcagcctcctgagtagctgggattacaggtgtttgccaccacgcccagctaatttttgtgtttttagtagagacggggtttccccacgttggtcagtctggtctggaactcctgaccttgtgatacgcccacctcggcctcccaaagtgggattacaggcgtgagccactgtgcctggcattcattttttttttttttagacggagtctcgctctgtcacctaggctggagtgcaaggtgcggtggcatgatctcggctcactgcaacctccgcctcctgggttaaagcaattctcccacctcagcctcccaagtaactgggattacaggcacccactaccacaccgggctaatttttttatttttgtagagatgggatttcaccatgttgggcaaactggtcttgaactcctgacttcaagtgatccacccgccttggcctcccaaagtgctgggattacatgtgtgaaccaccgtgcccagcctgaaaatcacttttgtatgacactgttctgaatggattgacggaagtaagtcaatgtgaaagaggctttggaaggacggcagatgccgagtgtttattgcttaagttctcactctccatggctcagcacaaaacaaaagatgttttacagtggcctaaaattgcagttgcttttgccatgaaaattcaacacagcatctttgctgtaagagtgacacagacttgaagggtctgctgttaccgtgatgaacattttcaaccaggtgagacgctgagagtgagaaatctcacctggacagtgacacaaagccctcccaagctacactctctgagtggctcctgccttttgcacccttgaacgtggccatgcacagaaaaatcccaatttgggatgcatctcccacagccgtgcttcaagtaacctggagattgcatgtcagtccatgtgtccttgtcttaatagaaattagaagagaagaaaaacaaaagccccagcctcgtgagagagtctatagggagtagggatagaataaaaggtaagttaatccattctccatttctgctcctttttaagattttttgttggtatggaaatttgtgcttagaaaaacactgcagatctgtacccaagtgatatgatcgaataaaaataatcttcaaaaaagtcatcgaatttagcagagaaaagcaaaaataccagatagtcaaaatagtaaagtcactctccaatttacaatcaggactgtatccagatatttggaacagaggaggttttctcgctgagtggtctgcaatggctaatgtttgccacctcattttgggcgtgcagatacagactttgcttcattttgggcgtgcagatacagaatttgcttcattttgggtttgcagatacagactttgcttcattttgggtgtgcagatacagactttgcattgacagatgaagctcaggttgtcttgtcacaggtggtctcttagatcatgttaacctaaaaacaggagcaatcagggatagaaagtccagccctgtgatccaggctcacgacttcttcccaggcctcactttgctcaggggttacactaaggggctgcactagatgacctctagggtctctcgtctgactctgaagtttagatgtaaagaaccaggttggctgtaagaagatgcgtattgcacacaaagagccagccagggaaggtcttggcttaataatctaccccttactatcatgcgacacgagagccagaatcagatagagagctatggttgcagggaatggaaaactcagtgcaaacaggtgtgagcaggagggagcttcatgggctccagccttcaaaaatcccagagataaacagcatcaggaatgattggatcaggctgtggctcagtttccctgaagttctcttggttctttcctctctcacgggtcatgatttcagactgtcctctctcatgggtcatgatttcagactgtcctctctcatgggtcatgatttcagactggcttttcttgtggtagcagagaaggctgcagtggttctaagagctgcatcccatccaccttgtccagagcaaaccatggaaaagccagggctcccaggcaacatcttacctttcactggcccacctgggccaggtgcccattcttgaatcagtcaaggtcagagagtgggaagagctgactgcatcaggccaatcacagcccactgctggggctgggggcagggacagggccatgggctactgtgctgggagatttggggtcaggtgaagaagggcctggtgaattgttgctgtaatccttcagtaggaacccattgcagggagaaagtcactccatcttctttggcaaaagagaaacaatcatactcctcttcttccaaccttgctgcattgtcataaggatggaaacaggtcatgagaggcaaagctttggtatgagcaaagccctgaataactgttagcaggaggggcaggcattgtagctatttctgatctcgttattaagggactaaaatttgtttactgtaaagttggttctttcaggatgatgcagtgcctactgtcaaatatctcaatcaaaaaaattaaaaattatgttactttatggtgaaatctgtattgcatgaaattgatttttaaattaaaattaattttcacgacacaagtaatatatcatgtatttccctgtaagaaaaccaagacattaaagataagctcaagtccccatttaccttccccagtctaccacccccctaaattctcagaaagggacatttgacctgagatcgcctcctctggagtgctcatcagtgaagacccagcagatccccagtcagtgcttgaattcctttaggtatgaatggagttgagttcatcctgagaaagacccctgaaggccaggctgaagtcaggtgcatggaggtccccagagaatagcagattcattctatccatgtccatgcagcagctgttgggtgtgagttggccgtggggaggcaggatgtgtcctctttgcagagtggtgggagctggcacacaccgggcactattccccgtgccctgtatctatgatctcactcagtcctcacaccaaccccatgagatacggcactattactaagctccccatgctgcagatggggaagctgaggcagagtggtcaaggcacttgctcagggggcagtgctgggacttgagcctgggcagtttagctccagggactatgttcttaaccactaggccatgtgggctcaatctgtgttaaatctggttgggaggcaagagtcccaagtgagagaactatacaccatcaacaccagtaccaacacatacatacactcatacctcccctgcccccctccccccccccccccacacacacacagacccacacaggcatgggtggctggaatactggggcaaatccatgaatgtttcacaattccatcttcagattccctgtgcatccagaattaaccttcccgtcactccgcttaaccccacctgtgagtctcaagtccccttcacagctgacaatggaaacccacagacaggactggccagacctagtggaaggggcagggccatccctctgggctcagggttccacttggtggaggctggaccgtctcttctcagcgtgtgctcacagcgggacctgctgtctctttctgaggggacacaacccccatcatatgtcccccgggccgcgatggtggggtcaggactgagcatgccccgtgcccacccccacgctcagcccgagtcaaagccttcgaggctctccagtgtcatctgcacaggacccaggtgccatcgcccccaggactctcagaaactcagggcggtccccgagcagctcacatctcctggggctgagcatccgcagatgctgtaggaaggaggcgactgggtgaggggaaggatcgggaagcagagtttggccaaggctttgtcggagccactggtcccacgcgcacggagctctaagcagttcctgcctctctgagacggggacgggacaggccccccatcaacctctcgctctctgggcttcggttataaatcaccccacaggggtagaaaccacccagaaagccgggagctgctccaggagcttacgactggggtgggctaatctgcagagtggtcaaccatgtgctcatggccctggagtccctgtgaccagccctggagacgtcacctcagagggagggcgctttgcccgcttccttcaccgttggggccgggacctgaaacttgggcacagagtaaatctcagtaggtatctgttgagtgattcggagcccacctgtcccacatacaccacgaggaggcctccagggtgtccacaaaggaggcggctgggctggggaagaaatgcaagaattcctgcctggacaggtttcatctacatagaaagaggagattcactcccgaaagctatttgtcagggtctaccctagccacaatgatgcctgacagcctggaggtgtgaccagatttgctggggggagacggacatggttttgacaggggcagggccaaagtggggcagggccaaacaaggcaggggccagggtcatgcaggggcgtagccaggatgggggtgtggccagaatgaaggcggggccactgtggagaggggccatggtgggggctgaaccttgctgcaggttgtagaagcgctgagcccatataaaggatctgctagcccttgaccttccccaggtgtctcatattcccatcactgatggttcattctcccatctcccattgcgctggctgcttttcattgaagttgtgacaactgtcatactaactcattcctttggaaaaggctactgaaaaggtgccaccctggagatgctactcaggagaataaccctgctggtgactgctttcaccttctgcccctgaaagggcttgactgtggggggtctgagctaccctacaaacatcgtcatatccgagggaacgcaacattgagtagcaaataataaacaccatgacaggtcaagagacagactgcagaaagaaagcaaaagctttcttattttagtacctataatgacattttgttcttgcttttgagcatgtggcctacattttcattttgcacaggctgtgaaaattatgtacttggatctgctgggagaatgtaataaatctactaagagtcaccctcatcctctctgtcccgctctcctgtgtctctcagagtcagcagagggccttgtcagagcacagtcctcccgcagtcttcctcatctctgtaaatcgcagccccaccctcccagctctcaggccaacacctgggagtcatcctccactcttccctgccttccacactccgcttctcatccatcagcaagtcctggcagctctacctgcaagggatctgcagtattggactccctcacctcctccactttgaccacatggctccggtcaccatcacctccacctggcctccctgttggtcttgctgctccagctgttgccccacacccccaacctgtcctcagacacagaatcccattaaaaagtaaaccagaccacatcctgtctctgctcaaaccctccaatggctcccacttccctcagagtaaaagctgaagtcttcacagggtcgcctaaggcctgagatgacccatctctctctctgccccactgtgactcatcacccctctggcctcatcttctaacaccccttggccccagccacacggggctcctggctgctcctcagcctcatccctcccctcgtgtctctggactctgtcctcgctatcccctctcctgcatcgctctgcccccaggccccaggcagctcccacacctccttccagggcccagaatttacaccagatacacagttttctgcacatttgaacgaatgaacaaaagaaggaatgagcacatgcttcctcagcggggaatactgctcccaagagggccagagctggttcctggaggtgaaaagatttttctctcattatgtaaaaatacagatgtaggcacagtgcataaaccattttgcggtatttctgtagtattaaattcatggtgggggtgagtaagaaaaaaacctctatgaaggttccttaggggttgatcatgaattaaaggtgagaaaggctgaattagaggacagtccgctgaaatcacaggcttctctcccacacattgccagggcattggggaggctgtggaagacaaatcaagatccgtgcaagtgcctgaaagagtcacagccattcttcctggcgtttaatagaaggaatgcctcggtgctttggggaaacctttttttatttcctgccaagggacagaattacaaaggatgatatttgcattttcctgaagcctctaattttcccattcatcacttgtcagaacctgaggcccttcctcagcttatggaatgtttgcaaacacgtaatgatcccttttaccaaagaacgtcacaggctccacatggaaatgtgtttgtgttgcagaggctgctaatttaatgcattaatgtcactctgcaccatggcggggtctcagggcatctcatgtcaccgtgagcgagctggtctaagacacaggaaccatggaaaccatcccatgcctggttagtgagtagatgcgcagtggggcgccgttcactgccttgagggtgaatgtggactccaggagcgagggccaggccttctagagctccacccaccctgagatcacaggcctggctcaggcttgctggacttgcccaatggggaactttcaggggacagtttaaccatcctgaggggcagacagaccagggagaggccaaaggcacccgtggggttcccccaggaccgccatgaatccccttctcctccctctctccatcagtgcctctgtccttcccacctgcccagcccaggtgccaaacaccggcctcatccgaaaagtccaactgggcccaggacagtgattcccagacccagctgatcccgcagggagctttgggtcctgctggtccctgggttctggtgacaaaaggacatgcaggaaggcaaagtcccctctggatttttcatcatgagccaccctaggtgctgcgcaccgccaggctgcctgattccaccaagagaatctcaggaaatgaaaaataagattttagttgttaaatttcaggcgtcggggctctttgagagattgaaaacacctggaggttgggtgcacaatggagatggggctgtggggacgtttcctattcccagtggaatccgtgattatttaccgagcagcctggagaagcccagtcttcacggaatggaaaagctgagccgggttttcatgcacaaaccggaagccgggtggcgccctcacagcagagctcctgaccttcctgcctcgcacgtcctggcagcgggagggcggctgccttggacacagtttattgtgtggcgaggagggagacaggagagtacggggcaaaaaaaccccaacaaatggctacgccttaaaaacttactttcaaatgcccagttcacgcagttttctggcattttaccaaatcaggcaggttttttttttggcttttcccaccgtgtgactcggtctgccttgccctgccccacccctgcttgggcaatcgtgccccccgctgagctcagcagcctggcgtgaggtgaggtgtctgtgtggctgctgttagcaaatccaccattccgggggcttccctggatggtgatgtggctgttccccaacttgctcctggcccagtgacccgtggtggctgtaggagccgctgcagggttcgggcagcagtagtgaagggctttgctgctctctgcagtttcgatgtcgccctcattgtccatttcctcagcctaaggagacccggtggcctgatggacttggcttcgttccttctttcagctcagggggacgtgcatttttcctcctttgagtcgaattagcaatgaacttcccctccccagatggacagcgtggcatcgtcagggcccagctgcagctttccgggccaacgggtcttcgtgcattgtctgatttggttctgacaagcatgcgaggccgtgcggtggtcattatacccactttacagatgagaaaacacaaggtaaggaactcgcccgaggtcacagggatggctggatgtaaaacagactcctgcgtgtacagatatagagattgataagaagagaatttcaaatctcagccaaagcgaaggtcaagtcaatgctcttggggacgttcccttcactccccagaacgttccaacatggccagtgaagacactgtgtccccgtaaccctgggggagaagaggacggggttaatgaaaagtagaaagtttcctctttcccactgttggagatgccggcgtccccacatcaccgtcggcgctgcatctggtccacttctgggacccatttgggtccctgggccggggcttcctgtggatgagccgggatcacacagcgatgtggggttgctcagggcgccccgttcactccagagtgacccctgacccaaagccagtgctgggtgtttgcggaaactgaaaccagggcaggtctgagtcagaccctgcagaacaatgaggccttttgtgcaaatgaggcgggggaggggccgggggagaccaggagcttcctgacggggtccgcagcacaggtcacagcgagtgaattcaggaggtgaccctcgaaggtcaggtcacagccgagcagcacaggcgctgagctaagtgtccacaaaggagacgaacaaagcggctgctgtgggaacagagtcagtgtcggtcaatgctgagtccaggagctcgggcctgccggtcggcgacgggggcttcatgctggctcccccaacagtcaggagggccatgtgctgaggagggagggtcctcagcgtccccaggattgctggtgggttcacctagtggaatcgcaggggtgaatccactagttgagatatttttctccaatggatattgaagtgaataaataactattgatataaaaatatacttcccatatttacttgtaagtaaattcatcagaccccaaaatacccatgacttcacgagccagaggtttgcttctatcccatgtgacagccccggcgtgggggccccctggctggttgggcagctcccggggctgagcctcgacactccagtcctgtgatctgtcattgacaaaggctgtttttgtctacctggtccgaggaggtgcaagtcacatcagacaggagggaagaggagaagggcaagtggagcgtacccattcatttaagggtacactgggaaggtacacaccagctgcaaggcagaatgggaaattcagctttggtccgggcagctaaactttgggatttccaatgtgaaatgtaggggatgaggggtatcaagggtcagcccgcagcctctgccccctctatgtgctcctggaagtcatctactctcctaccaggggatcccaccagggcatcccacattttgtgaaaattagctgattaggagagcatcctttctgcactactgtggagggggtgggggcttaggcatgagcagttccctaagtcatggtacagggcctcccccatcttgggagagcaaaggctgtctactgtgtccaccaaccctgaggcacacccacacagctttcctgctgcctgtgctgagccaggcactgtgcttgagatgtgcacggtatttgacatagagtcggggtgggtggtgcccagactcccaagtcactccacggtgagacagattcacagggctccaaggacaagtcaaaataatttggccgagcctctttgttttagaggttggtcaactggtgtcaaaagctggagaaggacttgttcaaagtcacagagccaagagccacctgggtccctggtgtctttccagtgaacaccaccgtgacctcactggtcctgaatggtccctttttaaataaagagatacatggtcatcaaatgcaacaccactgaatctgtctgttccctgcccacctcttctcagagacatccacaagtaatcctctagctgtttccgcacattatttccgaatcctgaaagaggaagcttggccaggtgctgaggctcatgcctgtaatcccagcactctggcaggctgaggcgggtggattgtttgattccaggagttcaagaccagcctgggcaacatagcaaaaccctgtctctactaaaaagacaaaacattagtcagacgtggtggtgtgtgcctgcagtcccagctacttgggaggctgaggtgggagaatcacctgagcccaggaggtcaaggctacagtgagccaagatcgcaccactgcactccagcctgggaaaccagagtgagacctgtctcaaagaaaaaaagaaaagaaacgaaagaggaagccagggaagctattcatagagctttcaaggtctagtgttatctaatgtctgctaagctagatgagaagttagctcttacaccacccaccagctcccttcctgccacgctgtatgatacatcactatttttaattgcatcataatcagcctttatgtcatgtgaccaggtaaatgctattctctgcagagcgaagtactataatattttctttcttacacacctttcatttttcctagagttcgtaattttcttgtttttttttttttttttttttttttgagatggagtctcgctgtcgccaggctggagtgcagtggcatgatcttggctcactgcaacttctgcctcccaggttcaagcaattctcctgcctcagcctcccgagtagctgggattacagacgtgatgctggctaatttttgtatttttagtacagacggggtttcatcatgttggccacgatggtctcgatctcctgacctcgtgatccgcccacctcagcctcccaaagtgttggtattacaggcatgagccaccgtgcctggccttcttgttctttttatttgcaaagtttacttacagatacttaattatttctcaatcctccgtcagtgaagccactccagtgtttttcaagctgttttgatcacaacccatcataagaaattattttacaatggaacctggtacatacacacacacacacacacacacacacacacacagagacacacaccccccatatatatgaatataaagtttcacaaaataatactgataccttttgatattttctactcaactctgtgattaatgttttaaaatgctagttgcacccgctgaactgacgttagtttgaggagctctaggccagtcccacgaggtcctgctctgtgcactctcctgaaactgaccagctcccatctggactcttctctctgctgctctcctgaggtgatcagttttttttgtttgttttgtttttgagacgaagtctcactccgtcacctaagctggagtgcactggcgcgatctcagctcactgcaacctccgcctcccaggttcaagcaattctcctgtctcagcctctggagtagctgggactacaggaaactgccaccatgcccggctaacttttttttcatgtgtttagtagagacaggatttcaccttgttggtcaggctggtctcgaactgctgacctcaggtgatctacctgcctcggcctcccaaagtgctgggattacaggcgtgagccaccctgatcagctttttgatagatctcatgtcttctctaattaattttctgctttttatgagtcactggcaaattacttttttattgacagaaacaaaatcgtaactctccagcattttatgttttcttaccattcctccaataacagaaaatactaatgagaaggagaatattacaatgaaaggaagcaggagagcaaataagagattcgacctacacatggttttgattctgcgtgaggccggtcatacccagatgaaaagctagacatccagctacgtacatccctggagatacccagacgatggaatggaatgttcactgtggctctaagtcagagcatctcatttaagctttatggacagtctgcgcaggatgtgtctgtgtggggacttctcctgtgcatcatgggaggtttagcagcatccttggcctcactcgccagatgccaatagcatccccctctcctagttgtgacaattgcaaacatatccagacattgccaaatgtcctctggggggcaaagttgccacagctgggagccactgctctgcaggtttggacgctgtgcctgcaattccatgcagcatcacgggctattgatcatgtgtcagacggagcttaaattggtcgatcgcatcctcaagtagccactccagagcgtgattatctgacacctgtaatttaccatcctggttacatggggggcaaacgtggaattatgcacatcagcgggcccagggcctgttttccatggacttagtgttcctgctgagcatggcctcggtctccccgagttgttaaagacattgacgcctcagaactgactctgcctccacttaatcagctcaccagaaaattacaataaaaatcatctgccacttatgaaattgccgttaaaatggactatttcctgccacctggggacaggctgctgtttctctttcagcatcggtatctgagatgctgtctctgggaaacagcgatcatagatgctgttgagacactccattggccacggtgtgtccctggattgaaaccaaagtcacaacaatgagtctgaaacgtaccgaggaatcggttccaaacatggcaagagcaatttcaaacagtgctgcgagggccctttggggtcaggacaggcactgatcagctgagggcacaggccctgtgccgccacggctcctccaagccagcactgctcactccgtccgtgaaatcccagccaggaaggccaatgtatctgtgccagtgcctgaaatgtcaatatcacaaagccagcaggaggggtgacccggtggagctcagcaaagatgacataaaacaggccacaaagctggtttgccagggtgcaggaggatttgtctgttttctcctgagaatggctgctcagctcactccacacagcatttccatgcttcatctgttagccctggaacgggtgccctgggagccacggaccttggcaagctccactgtaggggaacctcatgctgacagctcactcttgtggattaatcctgactgtttgctgtatctggagccacccccaagaacctgatcatacagcacacaggaggggctgtgagcggagatgaaatctgggcattgtcttggttgttattaatttaattgtcattctgtctgagcagtttcattttcggagagtgatttgatcgcccttttagaaccttgatcatctcagtgtcatgttcttagagggaggcatccctggaagaggtgcccactgtggtgttcttttaattaaattcatctgttcctgcaataatgtggatgaaacacctgccctgcaagcaaaatacatacttgctcctattcccgggacccatagtggggtggagctgaccacagtgtgtgcgttagacgccactcttcaggcaggttcactcctgagtctgcactccggggacttccgctgtttcccatcgttgtgctcacacccacgcggttagcaagtgtgcatcgggagacggatttcgcaggtgctgagctgctgggtgggtgagccgggagctggtggagagaacgcaaaggccggatgtcgtttggttcttatctggaagatttgaggttgcaagaagagaactttccttctctgcagtcaggcagagctcaaggcaggtcctcagccttgtaaggtcagcttttcagccctgtctgcccacttctgctcatggaagtcatgttaggatgcctgtttgtgtccacggatgaagggcttcccctgccccccagcctcatgagtggcagctgacgctttcccgtccctgggtgaacctcacttccatttctcacagtgctgaaccaggagcagggggaacctgtgatccatgatctcccacaaatcccaacagacatgttctatagtttaaagtggttatacgagttcttatttttggatattatttgtatgtgatcaatttacatggtgcttattgggtgtttgtgttttttataatgtcggtttgtgggatctgggagaagaagggtttttatgaggaagatccttggggagacagaaaccttgatgcggggagctgtgagcgctccactcagggcagggagcacattcaggacgggctgggcagagcctcggaggctcctggctgcccctctccgagtgtggggcctgtggggcgactccattcaggaaggatctgtctacttgatgcaggaacaagcccagtaaagcctgcactgcagctgaaggaacgatctgtttgttctctaagaggcccctgcaggcaggagatgtcttaaataaccacccgcaggcagagagtaaaggactcagtgaagaaagaaactggagctcagtcctttgagggcagaaacgcatcccccacacccgtcgtgagctgagcacggccacgcctgggctttgtgggagcctggccaggcccagctcctgccctttgctgaacagggagtaaggagaagttagatagctgcagggacgtccttggcctgactggtctagccacctcactagcacgtggggcagatgaagctcagggaagccaagggacttttcccggatccccagggaataggacctgaggtcccagctcctgactcccaagtcagtgctctctctatggcccaaggttgctcagtacctgccaggcctgcgcagagcactttagaatcattagcccaattaaccctgactgccacaaacacatgaggttgggattgtacccattctacagatgagaaactgaggctcagagaggcaggtaggaggaggaatgagacccaaacctagcactgtgatttcaaggagcccttaacttctatatgctcatcagataaatattctaccctgtgacaattagtattttctcagattcaaaaaaaagcaaaagaaatgttaattcttggggacatggttctctaattagacattcaaagaaattcccagaactttgtgggttagcagtgatgttaagttactattggcttctgcccctcctacccggccctgccctaagcatttttctggtgtttagttgttgaaacatcatcacaaatttgtatgatatgttttgatgtgacatcattgcccctgtgttaagggtgtggaaactaggcagggagagcagaaattgcttgctctaaaacctgaacccatgattccatttccttggatatatgcctgggttggggatttggaaacctgtgggaggctgtgttattgagggtcattgttctcattctccatcttccttccctggatccgtgtcctctgtccgtgactctgtagtttgtgcatctagaggcagagtctgtttccttgtcctgttgatgttggctttggttgtgtgacttgcattggccaatgggacgtcagcaggtgtgacgtgggcaaagaggtggcatgtgctagcacagctggtcttgcctgcttgttctcctgccttccatcatgagataaataggcctctggttgtccctgtccaaggaagataggagaccctcagtacagcagacctggacccaactttcagcttgcagccaagaaaagccagtcctggctcagatgtgatgaaccccatcagacctgtggacatgagaatgagaaataagtactatcgtttgtaactgagtttgggggtggtttgttacacagtgtgactgtgagagtagctgactgatacaaaactagagacccaacatgctgcagcactcactagcacccgaatgcacctgccgtcagggccatcttctccggacacaccatgctttccattgcccccagggcatcttcatgtcagatgatgggtccttgcccaccgcatcatgttggcccctgtttccaaggggcaggacaagctcttctggtctagttcagtggagcactaactctgtgcatcaggggagcttttgcttgtttgttttgttttgctctaatcagacgtgcaaggacctattgagttcttctaatgcagagaaagcctgtttggctatcattatgtcagtttctttttgacttttgcaaactttctttcactaaacattcgtcaaacctacagctggcctttctatggtgacaacaaaataacaggagtgtttgtgtcctctttggatcacgctgacatttctatccaccctgacatctttgctggagagaatccaactgtgccccctcctgacaactgttcctgttgggaagtttcttactaaataaccatcagcatcattatcattgtgcgtcttttggacaggaagaagggagggcaaagttctgtcccagcctattaggagtcaagagggaagcagacgggagcggctgacctctgacggcttccccagggggctctggctgggctgctcagctgtgttgtctcacagcatatgcttcacagctccctaggacctcagtatcattcttaccataggacagaagaggacagcaaagctcagagaggctgtgtcactagctttaagatttagtttcaaccttagagttaggctttccctcttcctgattataaactgaaattataataacagcgagtcaaggctttctaaactaagcatattcacaggaatattgattataataaccaaaagcaaaacaagaaaaaaaataaaaattgtattgtccagaaatagaagattggtgaaggcagttatcgtatatctatatgaaatacattgtaactaatgaaatttatgtttttgaaggctgcttgatggcctgaagaaatgaacatggtataatgtgaagaaaactcaaggcagaatctgatgagtaaattaacaaaacttccaaactaactaaattaaacatttagaataaatcctaattttataaaccaagtagattttatatgtgcattaaaaacactggagttagattttattttttctctatttctaggaatattttataaacttttcaattactttttaaaatcagaaaataagtgaacattcttaagagtaaaaatataataaaagcatagagcagccttgaggtgtgacgggtaactgtcttatcatctgggacattttttcatttcacaaatgctcccttcttctttgggatgcctcagggcagggaccctgtctcctctctgtcttggtggcaccaggaacaaacatggcccaataaataattgataacaacaattgatagcgccttgaaaggagtccgttcacttcaggtggctcactaactcctcaaggctttctcttaagtgcatttcatttgtttgattttttttttcaacttaaatggatgaaaattaaagccaggagagagctgttggctcgcggacagccagaaagagaaaaataaatgagtgcagtccctgaagggccacagggtgggggctggacctgagcacctgccgtgtctgaaagtccattttttgcccagttgttctctaaggcactatgatctaaaagtcaaaaaagaaaatggatgatgtatggaacaacattcaacattgttactacaacataagaaagttggatttagagatcagagagaacggtccctgcatcagagtcacttgctaacaggtgtgtactgagtacccacccctgccaggcactgctctgggtgctgggacagggcagggaacaaaacaacgccccctgcccaccacccactgcgaggttactttcgagtctggaggacaagcagtagccattgaaccggcaactgcatgatgtgcgggaggtgggggctgttctaaaggacgatagaggtgaagggcaaggccgtgtcaggggtcaggaggcctctctgaggaggtgggcgagccctgggaagagcatcccaagcagaggcacagcaggtgcacaggccccggggcaggagagaccttggtgatcctgggtgaggaacagcaggggggcgggtgtggctggagccatgtgacccagggggaggtgagaggagatgaggtcacaagagagggcgtggagtgaagcggtgaggggtgacctgtggcctgtggtcactgtctccaggtgagcaggtcccagtggagagccagggctctcaggggtcgttctagggggaggagcatcagcaccccggggccctgctgggaaagccagctttcaggctctgctgagacctcctgaattggaaccttagggtgggcctcgccatcggagttttaacaaggcctccagaagattctgacactcaccagagtctgagagacacagcagagctagaacccgggctccagttttcacccaggagacaggaggattctggctggaagggcaggagggactggggtcccccccagaaggagcgccccaggacgatgccacacaaggtggacattcgctcctcctgggaatgttctctaagggttgcttggacaggaaagtggctctctgagctgcctggcattggagatgctggggtgagtgccccaggagcaggcctgcactggtgactgacaggcaggaaataaacaccccagcttcccctgtgtctgggtgactctgaggggcgtcccgtacacagatcccaggctgctcagcaggatcgagttgggaagggggttccaggacaggaagcagcatgactagaggtggaagaaccttggcatatgcagggcactgtgtgtaattccatcgggctgcagtgtaagcttgcagagaggaggagggagagtggagtgagatggaaagtgactgatgaaatgtatgtctccccaggaacgtcggtcacggataagcccccagtgaagggacttaggaagcctctcccccttcgtgttctttccccagagagtcttcagagactggaaatgcttgccagggaggaagaaccactttctgtcctccatcctcaggagcacagaagggtgaagctgagcccacatagagaagcatctcatgctgtctgcagcggctgcagcgctctcctggggcaggagatgctcaaaggtcaacatgactttgaaaaggggctgggagaaaagcccccagtgctggctctggactcactatcccagggctcttaaagggctaaacatgactagattgtagtgagcctttcctaacatgcaaagaagcatccagggataatgtctaaatacagatgtgctatttctctcctccttctttttcaacttttccgtcaccctcagtgtcctcacagcagcttccccttgtcctgtgacaaacctggagcaaggtgctttgggtgggaggcagagtaacatgggagaccctgagttctgcatgtctctgcctgtatttccctccttccttctagttcatggaggtaaacaggtgtggcgactcctcctggcagggactttcacaggacagaggcagaagctacttgagaaagatttagctcatcagagcgaggggcggggtggagagggaaagagatggaggagaagattactgaagaatggaaaggtgcaatgtcccccaggtcctagggatgtgctggaatgcagagggtggctgtgaggtcccacacctgtaagcgggagtcactggattccacaggtggctgacctgctgaccagagatgtgagcccagtttcctcttctgtaaaatcaggcgtagcccggtggctttcaaccctggctgtatgttagtgacacctgggaagttttaaagatttctgacgcccacatcggactccagatctatcagatcagaacatctgggtttagtatctttagtgtccctcaggtgactcaaatatgcagccaagatggagagcactaacctaagctaagtcctgtttatgagaatttagagaccaagaaacacttagagcaggtaggatcctaagaaatcacctgatgcaactcctaccattcgcaggggaagaaactggttttcagagaggccaaatcattcacccaaggacacagagcatgctagtggcagagccatttccaatattccctctgcctcttgacctccctagaagacccacttgaagctctcaacttcacagtagagctgggtctgagaggcccacatgggatccctgattccaggaaggaagcccaggcctcctggcagctcagtgagtcacactgcagcagtggccctgaggcccctccttgaagaaaaattccaggaggcttgaaatgctctccaagatatagaaaaggaagatgtgcctggaaactggagaagattgcacagtggatataaatatttgggttttgtggcttcttttccccgcaaaaaataaacatggcagaattgcttctcactgaaagggcgtctgggtttcataaacagaccataaagaggcacctggagacccagaacatccccaaatcagcatctgtccctgccttctggctgtacctccatcctcctcggtctctctctctcacccaggctcacaatacaaggaagcactcttgccttttggaaaaaggacggccttctccccaccacttgtctcttggctcctcccacaggtggagggtgaatctgattggtgggaagataagactctgggctcctccagtgggcggggctaatatgcaaatggtcaaaagagttaggatgcttttggcggcaactaacagaaaatgcagctaaaagtggcttattttcttgctacgtaaaatgggttccatgaaccagcaatatcagttcattagaaatgcagaatctcaggtaatacccaacacttactgaatcagaatctgcttttctctttttaacaagatgacccaggtgattcatatgcatattaaattttttaattacttagagtcaagtttattttgcttaagctttctacctggctgaatatctaattacatattaattccaaatcttccccaacgcccctgctacgttttcctgtttgaaaaaaaaatcacaataccagaaggaattgatttctgatatgtaatatacattatttaaccgccttcgtgcagttcaggaaatgggttccccacattaattcatggagccacaaaaaatttagtgaaatttggctaaataattttagattcacacgtgattgtaagaaataggaaaaatctcacatgcacttcactcatttccccccaataataccatcttcctaattatagtaaagtttcacaaccaaaatattgactctgatacaatccatctatctgacccgggtttcaccagttttatatgcactaattagtgtgtatttagttctttgaaagtttattacatgtttagattcatgtgaccaccaccattaagattgaaaacagttccttcctaagcattcctcacgctgtccttttatagcttgttccatgaagagcaggtctatgtaaacctttccccaaaggcccagcaagctgagaggctgaagaaagaagctgacaaatccagcttctatgaaagaaacatttagtagggacctactaaagcgatatttcaggtggctgccagactgtggatccctacacccactctccagaaaatatcctttagataggaagcttctgtttttgtaaaatacgtgcaactactcacacctcagattgtgacacttgtgaccgctaaggaggttagataaacatatttatgaggggttatctatgctataggcattgtttctttttctttttattatactttaagttctaggttcatgtgcacaacgtgcaggtttgttacatatgtatacatgtgccatgttggtgggctgcacctgttaactcatcatttacattaggtatatctcccaatgctatccctcccccctccccccaccccatgacaggccccggtgtgtgatgttccccaccctgtgtccaagtgttctcattgttcaattccctttatgagaggttatctacactatgagagcaccttagtatgcaagagtcaaacactggtcatcatggcggttttgcttcaagatggtgtcactcttgccacacaaaaggttgttttcctacatagctatactcttctccttccttcctctactcctaatgcttggaaaccactattccgctctccattttgataattttgtcatttaaagaatgctgtagtggctgggtgcggtggctcacgcctgtaatcccagcactttgggaggccgaggtgggcggatcgcttgaggtcaggagttcaagaccagcctggccaacatggcgaaaccccgtctctactaaaaatacaaatattagccaggtgtgatggcgggtgcctgtgatcccagctacttgggaggctgaggcaggagaatcgccttaacccgggaggtggaggttgcagtgagccgagattgcaccactgtactccaacctgggctatagagcaagtctcggcctcaaaaaaaaaaaaaaaaaatctaagtgaggtcatatagtgcataaccttttgagattggtttttttcactgagcttaattcccaggcgattcatccatgccatcacaggtattaatagcttggtccctttcatggctgaatagtatttcatagtagagatgcaccagtttgtttaactcattcatcgaaggacatttgggttgttttccagtttttcactattatcagcaaagttgctatgattattcgtatataaatttttatctgaatacaagttttcatttctctgggacaaatgcccaagagtgcaaatgccgggttatgtggtaagcgcatgtctaatttttggaagaaactgctgaactgttttccagagcatctgtgtatcagcaatgtattgtatgagcaatccaatttttctatacccttgtcatcatttactgttaccactattttttattttagccactttcatgtgggtatttagtgattttaatttgcattttccttatggataatgatgttgaacatctttttgtgtacttacttgccattcatatatcaccactggtgaaatagctgttcatgtcttttgctcatttcctaaatggatttttttttttactgttgagttttaataattctttatattattctaggtattaaatcctttgtagcataagtggtttgaaaatattttctcctagtacatagcttgtcttttcatcctcttcacaaggcctttcgcagagcaaaagtttcaaattttattgaggtccagttgatcaatttttccttttgcgcattgtgttttctgtgtcaagtctaagaactcttcttctagccctgggtcctgaagattttctcctaagtatttttttaaaaagttttatagttttacgtgttacattatgagtccaaaatccatttttgagttaatttttgtatcatgtgtgacagggtgtgattaattttttgtctatgtatgcccaattttttttctgacactatttgttgaaaaggctattgaatattaaagttctagaagcacaggcttaaattacaaaggcatttttttttttactcacttaacaagacgtccagaaaaggcaactccaatttggcttactctgtagctctaggaagtctctgtctgcatctctgggattctctggtcttcgccttggggtttccggtggttgttgtggctccagcatcaccagcctgtgtccagaacagaggaagggaaggagagctgggagatttttctcctgtgtggcttgggaaggctttcccggaagcctctagtagatgtctcttaggtcccattagctattaatagaactggatgacaggcctactcgcaaaccaatcacaagcaaaggggagaggattactgtgattggctttgaaccactgaccaatcactttgctctgcttagggctgaggcagggccaccttccttcagcacattgttttctactggaggggtgaacaaaagtgtggctctgttaccaaggaagaaaggaaagtggttgctcagtgtctgctgtgaacctggctgtccctatgtgtcctctctcctctgtgtatgtgtgtgtgtgtgtgtgtgtgtgtgtgtcttgcaaacatcagtgcacaacacaccacagtcccataattcagtggagtgtgtatctgctcggcagactccactgtccccacagtcagggtccaggcactagaaggtatgtggcaggaaggtagaggaagacccaagccacagacccccatccaacttcgagtgcaagcaatggaaaccgactctggattccttgatttaattttttgaagacatttataggaagaaatgggttaagtctgtaggaaaattaaatatgaagagccagattcacggggcttggggacatcagggcagctcctgggtcctctgtgtggccatcatggtgaatccactcatgtgtcactgttcaccattcaggtccccacaggaggacaggatggtcctgtcttggccacatgttaccccctggactcagggacagtgttgtcatttgactgaaagtccctcctcaccacaaggacagggatggggagtttctcagcggaagcccaaggatttgcttaggcctggagagcaaaccccacacgccctccacacatcacctgcacagacgcccctccagctgagccagcctgctcactacccctcagacagtcttccctcccatccttgcttgtgctgggacccctcctggaaggctcccctctcctgcctgctcttctaactttcatgatccttcaagactctagttaagccaccctcctcctccaacaagcaccagccattgctgctgctgtgtcgaggtttctgaacctcagcattattgacattttgggctgggcagtctctgttgtgggactgtcctgcacattgtacaggatgcttacagcatctctggcctctacccagtaaatgccagttacacctttacctagtcgtgacaaccaaaactgtgtccagacattagcaagtgttccccggaggggacaactgcccctggttgagagccactccttttctgaacctgagtcactaagatttactgccatagcaacttaattacattgtgatgtttacttaacttctcactgctgcttattactttggcagactgcagccagccagagaacagccaggttaacccatacggtggccccacactaagttgtctcccacaccgtgtagggatggctcagtgcacagggagcatggtggggtttgggcttgatggctttgaagcctctgctagactgggaggcacacagtttggtaccatgtctggatgcaacgtcatgttcctgaggcaggatggtgcttgtgtaccgaagacagtcttgctggctgcggtgaaggacagagctctcggtggatccagtgggaaccaaagcctgctgtaaccctccaatagtaacagccatccgctcaacctctgggcccaggcacgcctcacaggagctctctacgggcactgtctcatccataatgaattaggtatcagtgtctggtttttagagattcggaaactgaggccagagcattctaatgtcctaagcacattcatggtgagtaggagcagagctggcttccacctgcagggtctgagtctagggtcagtgctcatagccacgattctcgtaggctacccaggcccactgtctccttgagcacccatgtgccccatgcagcatgtaacttgtaggaaatgaaggcgtttgccagcctttgcctgtgtccagtgtgaactcatctcctatttagcacaaagttattacattagagttactgatttagtggatacatcactttactctgtcatcttgacagcgataagatctgcattttgctcacttctggatcacgcaatctagcagaattcttcatgcatggcaggaactcatcattatttgcctcatttaattgaattgtattatggttctgtggacacttcatcacacctaacagtgttttgcacaaagcaattgttaaaaaatacttttcaaagggctaaatgtttgatcaatcaataggtttttaattgagcatccttacaagttaatatcataaagtgatgataaaagtgtttttattactgtgtgttggttacccggattaaatgtttcttgaagcctcagagtgcatgatgattcagttcttctgattttaagctcggatctattcagtgacgagatatgcaggtctggaagcctctgaaatttataatgtggatgctgagaacccatgatgctggtggccaattttgaaaattgttacagaaatttatattcattagacatgatggcaagttctggaatggtattctgcagagtcaatttaaagaaatttgtttcaaggagataactgaggaagcagcaagcagagacactaacttggatgtgacaccgctgagagacaaaactcagcttgatgaatgcagccaagccaggaaagggctgtggacctgtcccagaggggccacctattttctgacaattggcaatgttatctattaactagaaatctgttatgggacaaggagaagattgcctgcagctctcggagaataagacagttgtcctcttggcttctatataatatgtctctaagcaatgttttaggatttatcagcggtgagatccttggatatttaaccaagtccccctgagggctataacatggtagtgatgggaaatagagctgggggcaggggaagaaaagctgggatgtagctgttacccctaagcacattctcctgaagtgatatctttgcaataatctgtttcaataatatgttgacatgggcagtattaagacaataatcagaagaatttagaggaagcattctgaaatatgcgagtgcagtgtaagtggccagaatgtgagactcccaggtgaagtcgagggtgaagagtctacatggaagtgtgctctctcaccgcccccctacaaatggcagaagactccatgcagactcacccccagtccaccgccagagttaggaccagcctctgactctgcgacttataagatgggagagtgggagtgcgggaactatccccctctctggaggaggaggaagcctcagggctgcaaaagctgcaggcacattcttctctggtgctctgccatgggattcatgctacagcctgcatgactttcagagccagagcttggaactgcttatcctatgctgggagtttcttttgccaagggttgtgtctcctgctgggagtgcaaatacatctacatcaccttccaggcagggagggagaggactaaaagacggcaccagcaaatcactttaagcaggcagcaaaaccacaaaaataaacccttgaaaatgggactgaatgacacgcccacatcactgataaatgccattttcagcagactcatctcttcgccagagagatcagtcaacttggactcttgttaccatcacatttggcaccaggtatctgctacactctacaaccattctcaagttcgtgtgcagttggccctgtaatggggagctgagttggtttgaaaagccctaattacaaggcttagtgtttttctttgtaaaagggatttttgagtttagaaacaaagtgactgtaggtacaaacagatgcaaagcttcaaaaagtagtttatttttcattctgtgcctctattcacccaaagcacaaccctccacctcactccatccctggccaaaaactgtggcagcggaggttggagaagtaagcacaatattttctttaggcttggagagtaaagacctccctaggtagcatgtcatttccaaatgttactatctttccaattgatctcatccagagttctttgtctcaggaccaagagaattaaggagcatggacacaaagggtgaggttggagtgaaagtttaataagtaaaagaagaaagctctctgccacagagacggagcctgaaagagggttgccgtttttacagttgaatgcaaaggcttttataagaaactgatgagggctgggcatctcatttgtgtaaggctcgaatttctggtagctccaccccatcctcctaatgcacctgtggccccttagcttgagttacttcatattgtttgttcttcttactgtttatgtgttagcggatggaattttccattatgggcatgtccgggcaagtcacctgtgtagcctttattacctgtgcagacgtaagcatgtctcaggcaagctcccctgtgcaagttcccttatctgtgcctgtagctcgagttatcaggctgttcctttgtttgaaagaattcaactgaggacccaccctaactgcctgcctgactggtttcttgttttctcttttctcactaattgcccttggaaactcaacattggagatcctcatggaatattgaggtgcaaggggcccttggagttgccctgttgttggggtgggtacctcagtgagtgaggtcctgcagggaggctgggctatgagcccctgcactcggcatcaggactcaactcctctggtctgtctggagtccttcctgggcattaccctgacttctgagcccctgcactcggcgtcaggacttgactcctctggtctgtctggggtccttcctgggcattaccctgacttctgggccccactcatgacagagatctttttatacagatgactttcttgctggacgtcatcttagcctcctttttttgtgcaacagtttagaagctccattaagaaaaaaaaaaactttattttttagaagtggactaatacatacctcaaactgtcaacccacattgtgatggtggagccatgggggtctccaggaagtggattattccctagacccctctcttccagagaagtgcatggtgtatgtgtgtgcatatgtctatgtgcactggggtgtgtgcctgtgagcacgtgtgcagggtgtgtgtgtgtgtgtgtgtgcgtgcacatgtgtacatatgtggaggccagagaagttccatttcggaagtgaatccaccatgttggcttctgattactcccagtttcaggaagacttctaagattttcagtttatctattgttccttgtgtaagagcaggtacttactgtaaatcctgcccttagttcaaacaaccttgatgttatcttacttcaatagttctacacatcccttctgaatcaccccttccctgtgggtctggggagtaatggtgtggggatgcatcaccttgtctcacctccaaccaggagacagacatggcttttgtttgcacatccctattacatgtttcttcctaagaaactggatttgtcagcctctctgttcatcctttcagcttcctcggaattttgagggtaggcttgcataggcctggctgctgtggaacagtgtgcttgtgtgagcacgtgtgttttgcctcttctgttagcatgatggccctggaggccagctctctgcatccattttctctgtgagtcctgcagcccccatccttaggagttaacagtgtctggtttaactcaggtgtatgggaagagagctggaagacgagtcaattactttttcaagtctagaccatccagactgactaagaaaggtgaaatatttcatcatgaaaacatttggagatctgaagatgggtccacggcaggatcacgttcccctcgccactgagattggttcacaggtgatcacataacccagggctaagccaatgaatgcacagtattccccttagccactggaattggttcagaattgatccaatcagagtgaagacagaactttttcaattgtaatagactattttttggagcagttttagattaacagcaaaatcagcagaaggtttcggaggattttcacatatccctggccccctcacctgtacatcttccccatcaacatctcacaccagagtgacacatttgctaaaatcgatgaacctacattgacacatcattatcatccaaagactatagttcacattaggctccattcttcgttttatacattctatgggtttggatacatgtacagtgacatatgttcatccttataatattacacagagtattttcactgccctaaaaatcctttgtgctacacctgttcattgctccctttccccaatccctcgcaaccactaattttctgatcttctgtcatagttttgccgtttctataatgttgtatggttggaatcatatagtacatggcctttcaggctggtttctttcatttagccataggctttgagggttccttcttgtcttttcatgtcttgattgctcatttctttttggtgctgaataatattccattatctggatttatcacagtttatttatccatttgcctactgtaggacatcttggttgcttttaagttttgacaactatgaatgaagctgctgtaaatatccataagcagggctttttttgtgaacatgagcttttaactcatttgggtaaatagcaaggggcatgactgctgctggatcgtatggtaagagcaggtttagttttgcaagaaactgacaaattgtcttccacagtagctgtaccattttgcattcctgccagcagtaaattagagctcttattgctccacatcctcatcagcatttgttgtcagagttttggattttctctattttaataggtggttactggtatctaattttttttttttttaatagagacgaggcctccctacattgcccaatctggtctcaaactcctgggctcaagggatcttcccatctcggcctcccaaagtgttggaattacaggtatgaggcaccggggccagtctcattgttttaatttgcatttccctaattgcgtactacagcgggcatctttttatatgcttatttgccatctgtacgtcttctttggtgaggtgtagtttaagatctttgacccatttttagttggattgttttcttattgtttagttttaagagttctttttatattttgggtaacagtcctttatcagatgtgtcttttgcaaatattttctcccagtctggggcttgccttttcattctcttgacagtatcttttgcagagcattacatttcaattgtaatggagttcagctcatcaattctttctttcatgaattatacctttggtgcatctataaagtcatcaccaaacccaaggtcatcttgattttctcctatgttatcttctaggaattttatagtctgcattttatgtttaggtctgtgttccattttgagttacttttgtaaaggatgtaaactgtgcgactaggttcattgttttgttttgttttttttcaggtaaatgtccagttgttggagcaccatttgttgagaggtctttgcctcatttgtactggttttgctcctttgtcaaagattagttgactctatttatgtgggtctatttctgggctctctattctgtttcattgatctatcaatgtgaccagtaccatagtgtcttgattactgtagctttacagtaagtcttgaggtcaggtagtgtgagtcctccaattttgttctcttttactatgtgttggctattctgtgtctctttttttttttttttttttttttttgagacagagtctcactttgttgcccaggctgaagtacagtggtgtgatctcggctcactgcaacctccgcctcccacgttcaagcaaattctcctgcctcagcctcccaagtagctgggactacaggtgcacaccaccatgcctggctattttttttttttttttttgtatttttagtagagatggggtttcaccatgttggtcaggatggtctcgatctcctgaccttgtgatccacccaccttggcctcccaaaatgctgggattacaggcgtgagccaccgtgcctggctattctgggtcttttacttctccataaaaactttagaatcggtttgtcaatatcctcaatataacttgcaggaattttgattgggattgcattgaatctgttgatcaagttgggaagagctgacatcttgacaatactgagtcttcctatttatgaacctggactatctctccatttatttagcttaaaaagttcttttcctcagagttttgaagttttcctcatatggaacctgtacatattttgtgagttttataactatttcattttgaagagtgctaatgtgaacggtattgcatcttaaatttcaaattccacttgttcattgctgctaaataggaaagtgattgacttttgtatatcaaccttgtatcttgcaacctcactataataatttattagttctaggagttattttgttgattatttcagtgtgtctgcatagacaatccagaccatctataggcaaagatagctttatttctttcttcccaatctatatgccttttatttccttttcttatcttagctaggacttgcattatctaggacatccagtgcaatgttgaaaagcagtggggagaaggaacatctttttcttgttcctgatcttagtgggaaagctaagtggagtttcttggtattaagtgtgatgttagctgtgggattttgtagctatttattaaattgaggaagttcctctctattcctagttcactgagtttttatcaggaatgagtgttgaattttgtcaagtgctttttctgcagctattgatataatcatgtgatttttcttctttagcctgttgatgtgatggattacattaattgatttggaagataagacttttgattcacagctgggaaacagaagctttttccctcctggaaagtgaggatgcaaacagtagtctgtgaccacgaggaaattcagagggaatgaagtctctggcattggagtcagagcaggagatgtacaaagaaacagagccaagactcatcaaacccatttgaggccctctacctcaactggagaaacctaatgcttcctttaaggtttagttcagtttgatttttgttgttgttgtttgcaacaccaaacatgctaactgatatatgccatacccctcaggtatttaagaagacgggggtcagggcacggtggctcatgcctgtaatcccagcactttgggaggccaaggcgggcagatcacgaggtcaggagatcgagaccatcctggcttacacagtgaaaccccatctctactaaaaatacaaaaaattagccaggcgtggtggcggatgcctgtagtcccagctactcgggaggctgaggcaggcgaatggcgtgaactggggaggcggagcttgcagtgagctgagatcgtgccattgcactccagcctgggccacagagcaagactccatctcaaaaagggaggctgagaaggtgtcagggatgttcagaaagggatttttttctgtgagttgaagacaggtctgtgaaaagctgtgtgaacttccttctagctgaatgacataacagataacacttgttctctggaaaatagatgtgcacacatgcatgcctgtgtgtgtgtgtgtgtgtgtgtgtgtgaaaggtgggaaaataatatgtcttacaggaataaaaaaagaacactaatatggctctttcaaacctcagcgaagctggtgggaagagcagctcaggcgcattttgtgaactgaaggttctgtgcacccgagtagggcctgagtacttccagggaggatgctcggcttctctctgcagaacagggtgtgcatggtctacagggaagctcctggcctcctgctgaaccgagaaataacttgaccaagggacggagcagggagagcaaacgcttcaatatctctgcctaactgtgtttaggcttgcccttgaagaggccagggtggaattgattaccacaagcacttccctaagaccagagatgttgccacattttccctgatgaatccattgtgttgtcaccatggcaaccaccacagttggggtctggcctggctggcgcatgcttgcaacagttcccttttaggatccaggagcatcctaggtctatgaaatcttgccctcagctaccacaaagtcttactcctctcagcagcaggtccaaattatccatgctgtaggcctcaatgttggcatgaattggcagcatggaattcactaggaagcattctttatttaaaaaaaaaaacacccaacattattatttagttcagttcctctgttctggcttcatgaaacttaaaaatgccctttgttggaaaaaagagatgatttggtcagctcttgctgaagcccaaataaagagggctggatttccccaccttgggtcacatgatctttgctaattttctctcacccccatctaagggcaccctgtagctggacttcagccatagaatgtgagtaagatgtatagtcagctgtttctatccatgggttttgtatctgtggattcaactgactgtgaataaaaaacatttgaaaaaaaaaacccaacaatttaaaaatacagattaaaaaatcaatatgttatgcagaatgtggatttaaataaactaaaacaaaaaaaccaaagttaaaaaggaaaacaaatttgaaaagtcagtatagtataaaaactatttacctagtatttacattgtgttaggtatcataacctagaaatgatttaaagtacatgggaagatacgcataggttacatgcaaacactatgtctttttatacaaagtactttagcatctgtggatatccgtggggggcgggggtgggtgggtcctagaatcaatctcccagggatactgagggacatctataattgtctttttatgaggaactcatcaatatggtgccctaaggccaattctaccgacactatacatggtaatagtcacaggattcacagtacctgtaactgtgaacaaatatagatccaccgaatggctaaacttgaaagaccacagattcagtagaagaatctcagtgggagcatctaaggttaggttcgatcacttcttaagtataaacacagtacacttttccatggacacacacatgtgacaactctcaggggcagatacagatcatttccaacagccagaaggcttcctcacaccccttgtgattcaacacataccgatatggtttgggcctgtgtccccaccaaatctcatgtagaattgtaatccccagtgttggaggtggggcctggtgggagatgagtgagagatgcgtggagtttttatgaatggtttagccccatcccccccggtcctgagtgagttctcataagatttggttgtttaaaagtgtgtggcagctcccctcactctctcttgctgctccggccgtttgacatgccagctgtccctttgccttctgccatatttgtgagagtcttgaggcctccccaaaagcagaagctattatgcttccaggatagcctgtagaaccatgagccaattaaacctcttttcttcataaattacccagcttcaggtctttccttctttcttttctttctttccttccttccttccttccttccttccttccttccttccttccttccttcccttcctccctccctctttctattttcttttctttctttctttctttctttctttctttctttctttctttctttctttcttccttccttccttccttcctttctttctttctctctctttctctctttctccctctctctctctttctctctctctctctctctttctgtctctgtctccctttctctgtctctctctctttctctctctctctctctctctctctctctctctctctttctctctttctttcttgacggagtttcgctcttgttgcccaggctggagtgtgacggcacaatctctggctcaccgcaacctctgcctcctgggttcaagcgattctcctgcctcagcctcctgagtagctgggattacaggcatgtgctaccacacctggctaattttgtatttttaatagagacagaatttctccatattggtcagagtggcctcgaactcccgacctcaggtgatctgcctacctcagcctcccaaagtgatgggattacaggtgtgagccccgcgcctcacccagcctcaggtatttctttatagccatgtgagaatggactaatacacacacccacaataaaccactactctgatttctacttccataggttagtcttgagattagccctgcttgtccttggacttcttataaaaaagatcatagcatatttagtcctctgtgtctggctttcctggctccttgctggatcagtaaatgtctccatgctgtttattgtagcagtggtccattttttttcattgttacatagctttccactgcatgcatagacctcaatttacttttccattctattcctaatggatatttaatattatttatttatttattttttgaggtgaagtcttgctctgtcgcccaggctggagtgcagtggtgcgatctcagctcactgcaagctccgcctcccaggctcacgccatcctcctgcctcagcctcctgagtagctggggctaccggcgtccgccacaatgcctggctaatttttttgtatttttagtagagacggggtttcaccgtgttagccaggatggtctcgatctcctgacctcatgatccgcctgcctcggccccacaaagtgctgagattacaggcgtgagccaccacggccagcctaatatatttttctattaggcatacaattgccatggacatgcatacacgtcttctggtgaatgtacatactcattactctcgggtaagttcccagggtggaaggactgggtaataggggaggtggatatttatttaactttagtagatgtttccagacatttttcactgtggctgtagtgacttgcattcccatcaacagcatgggagttaacagttgtcctacgccgttgctaacacttggtattgtctgtcttttgacattgtagctatttggtggatgtgtggacgtatctcattatggctttaatttgcatttttcttaggagtcatgacatgaaaaatatttttacatgtttattggatgttcagatctcctcctttgttaaggtttgttgaaatcctttgttccttatctaattgggttgcctttttcttactgatttttaggaattctttgtatcttctagatacaagtcactgtcaagtatacggtattacaaatgtcttcttcccatctgagatttgcctttttactcccttccactttcttaatgatgcttttgatgaatagaacttctgaattttagtgagtttgaattatcattcttttctttcatggttcgattaagaaattgcctatctctgcatgcagtttgatggtttctgtgaatcaagtggttaaagtgttgctgaaacaccaggggttcagtctaggtcctgctgcttgctacacagaaagccgatcattgatacaacaagtattgtcagggaagaaagctttaatcagatgctgcaggagtattgtcagggaagaagactttaatcagctgcttcagccaaggagatgagagatcagcctcaaatccgtctccttgactaacgaaaattaggagtttacatagcaggtacaaaatgtaaccatgtatgggaagacaggaaatagggaggggtaaggaagaggagttgctcaatagggagcaagtgatggcttaggcagacatgggtgaggggtctggtgtttcattgtctaaatgtagtcatctggtgagtttcagttccttgttactatctgggaggcctgatggttggtttcctgagaaagaactcagataagacaaatgtaactttctcaagctttgagaccaaacagggaggatcaggttttatgttcattcagaaaaaccctaagcatcagctctatgggacatttgggctagtttcaaaagataggcaggtggtgcaaaccaggccactgagaacctgtttccaaagctaaacagcttgaacaggaagcaccaggattcaaacctgggctttctggttccaaagagcacactcttacctgttgcattgtgctgcttctttactaatcaggactcctttggttgtgaatggttgaaatatagctcttaggttaaaaagataaattattggttcatgtacaagatccaggatgtctcgcttcaggcatggatggatccaggtgctcacatgacattattagcattgggtccctcccttcttatgcctctactttcctctgtgttggcttcatcagtagaaagcctctttccttttgcaagcaccagctatggcaatagcttctatttttcaaagatggctacaacaatatcccctgtttcaggcactcatttacaacgtggccttgatattcctcctactgagaagtcagtctatgtcctctctctttcatgctggacaggcttgtgactcattggaaaccagtatatagaggtgagaatgatgctgcacaacttgtgagactaggtcagaaaaagcagtgcagcttttgctttgtgtttggggacacttgcctttggaagcctgagctgacatgtaagtcctactgtcctgaggccgccatgctaggaggaagcccagactgtatgaagaggccacatggaggtgctgaggttgacagcctcaactgagggcccagctgattgccagcagcaactaccagattgagtgaagaggcttctagatggttccctgtgtttgatttttcctagctgaggcattggacattgtggtgtagcgacaaaccactctgctttgctctgtctgaattctggacccacgggacccatggaataatgaaatagttattttgagctctttgattttggaacaatttgttatgcagtaaatggaacaccaggtgtatcttctttcagccctttcagccctaccagaaagagggtcttcttgccaactgttctcaggcagggtaatccttgggccaggctgggtcacattccatcctaagtcaattgctgtggctaggaagatgtggtacacggatgggccagacctgggtcacaggcccaccgggagtggaccagccctgggaactgccacatggatttggggaaaggaagagaggctttctcaaggaaaaacggaattatatggaaaaaaattgtagatggaagatgggaagatgggcagggagaaccaacagctgctccttcagtagtttactatgaggtcactgtcctttgcttgtggaaatgagaagtgcccagcagtgagtgacttgtctgtgtgtttgggcagctcagctgttatgggagcaggtaggaggggcaaacccaggacaggcttccaggagagcatgtggctgtgctgacttcatgatgatgaggactcagacaggcaaaaagagcaggaaaaggagttccaggcaggggaatggcatgtgcaaaggcctggaggcaaagatggtgcagcaagttggagaacctgagtgaagttcagtggggtttaagccgagtgttagggtgaggatgacaagggaagaaggcaggggttggggctgtaggggcagacagtggcagggccttctcagccacatgtggcactgggggtgtctttaaatgcagtgggagacctcagtgaggttagcagggatgtgacgtgaccatagaaggtccctctgtccatggtatgggggatgaggaggaggggctgcccagggccagggtggtctgtgaggtgggtgaggccatcatgtaggtgagaaaggatggtcacctgagctagcagggtgatggcagaggaggaaggaatagaacagagccaagagccatttagcaatcaactcagtaggacttgggtttgagacaagagggagagggaggagataggggataagagagctgcccagggttctggatgggcctggagggacggggtcaccagtcactgaggcggtgacccccaaagagcctacatttgggggtgaatttatcgggctgagttgaaggtgccatgggacacccatgtggacctgcaggtctgaagccaggagagtggttggctggtgtggctaaggagtcccctgtgtgtctgtgaccccatgtgtctgtggtctaaggggggctgagacccccaggaggggaagcagagtgagcgagaggcagactcaatggagggaccccctggatttaggagcaggagaagaagaggacaagggtggcagagaaagcctggctgagcatgggaacaagaagggggccttcatcaattcctgctactatgacaatatgcctgagactgggtagcttataaataatagaactttattcctcacagttctggaggctgggaagtccaagacaaaggcgctgacaggttcagtgtttggtgagggctgctgtctgtgtccaaatgggtagaagggtgccagtcacatccaggagcttggcctcatgctggaatcacctcctgaaggccccggctcttaacactatcacgttggcaattgggttttaacatgagaatttcaggagacaccttcagacagtagcagaggggtagaccaggaggaacgacggcccaggaccaccctctgtggacacccaggagggactgggcgggtccttagggggagcacagggagctccataggagaggctttggggagcagggctgggaagcccagtgggagtgccggggtgagtggtggtgaggcaggggtgtagacactgaccgcaggacatagaatttccttaaagggaggaatgtgggctggagcgggggttgaggagaatatgtatgcgtggaagaaatctatgcagtgtccacagtctacagagaggcctgggctgcagaaggcaagccaggcaggtcgtcccaggcacagggaaatccccagagcttgggtttactgagcccgtcctgtgcaggtctggatctgaacactgtgtatgcagtatctcactgaagcccctcccacccgatgaggcagggccatcatgccacccattttaaagggtaggagactgagaccagagagggcaaataacctccccacagtcacacagcttggaaggggccgagtcagggttccaaggagagcctgtacccctccctgctgctcttagcctggctcagctgcagaagccgagccccagggaaggttgtggtttggggcaccccgtggcattgtgtgcacagggccaatgaggcgcaggactggggatggggggtggccatgtgtggcatcgttggtttctgtggcaggaaccagagttgtggcacccagggctgcagactccggttcctctctgctgagccccctttgggtcagggactcagttcctgattgtttcctgggctctggtttgtgcagtggcttgatctcagctcggtgcaaactctgcctctcaggttcaagtgattccgtgcctcagcctcccaagtagctgggattacactcgtgcaccaccagccctggctaattttgtatttttagtagagacagggtttcgccatgttggccaggctgttgtcaaactcctgacctcaagtgattcgccctcctcggcctcccaaagtgctgagattataggcatgagtcacgtgcctggccttggtctagcagtttttttcagacccagccccaatgggaaacagaggcatgcgctgcaggggtttgtggcagaattaagggaactgctaaatgatgaaagcacctggggaccagcaagagatggagctgcccagagcccagggctggaggggtgggtggaggagagtgcatgagtagcccagggagagccctgcagggaaggtcacaccacagggagagtagggaagaggcactctgacctttcccctcctgcctttgacctccagggaagagtccccttggctgaacataactggacgccagagggcagggagccccggagatgcgattctcaggggccagttctggaacagggagccccaggcagagaagggatccaagtactggggaaggagttggggaacaacaagctgaggcatctgtaccttctcccgacacttttgccccaggctgcagggggaaagtggaggagaacagaggagaaggtcccttccaggcccagtccaggctttgggagcacagggtgccagccaggggaggagagggagctttggagatctggaaaagccggcagagaggaagagctttaaggagagctgaaggtttgtgaccattgaagtggagggagggaagcaatgactgaggggcaatgagtgggctccgtgctcagcatgaactcagtatgggttattctatgttttctcattttaatgcattattttttttcgaagttccatactcttattacaaagtttaggtaatatgagagaagcaggtggcaagcacttgtctctccagatctgcttcctaatagagaggctggccggttcagggcttgacatttctgctcagattagtttttgagatatgatctaactgcctgttacttttttggtgggagttggaaagtatttcaaatactaatgtaagaaggccacttccttttttcacgttgggattataaatcatttgaaactgtttggggacaatgcattttacagacactctatctggccaggtacaaattgaacatttaagctcaagttcaaatgtctctcatccttgactttgatgtaaaaacatgtcatatttcactcgcggattgcatgtgaataagcaatatcagttctcagagaatggaaccacagcgaaagggaagatagtggttgtgttcattttcaagggttgccgtaacaaattaccaaagactgggtggtttaaacacaagaaatgtatttcctcggcattctggagggtagaagggttgatttcttccgaagcctttctccttggcttggagatggtcatctgctccctacatcctctgcacgtgtctgtgtcctctcttctttgagatgctggttgtattagtctgttctcacattgctgtaaagaaatacccaagactgggtaatttataaagaaaagaggtttaattggctcacggttctgcaggctgtacaggaagcatgatgctggcatctgctgggcttctggggaggcctcaggaagcttccagtcatggtgggaggcagagggagaacaggcacctcacgtgggagcaggagcaagagagaagaggcaggcgctacacacttttaaatgacaagatctcacaagaactcgctcactatcacaacaacagcacctcagggatggcgctaaaccattcatgagaaacacctccataatccaatcacctcccaccaagtcccacctccaacactggggactacaattcaacatgaaatttgggcaagatccaaaccatattactagtcctgttggatttggggctggcacaaatgacctcacttaaccttaattacctctttgaagaccctgtctccaaatacatcattctgaggtcctgggggttaggacttcacatatgaatttggaggggaatccaatctggtccataacagctactttgtttttaatgaaagcaaggcttttccttctttttcaatgatcccagttcacacccaaatctgtcatctcctgattctcagaggtattaatcaagctgtcagtaagaatttaccaaggacttgttctcagattcaaaggatagtgaatggcactaggacagttaaaaatcagatgctaaattcatagcacatatggtctagctgggaagataaaaatacttagcttttgtattaagtatttaatttaaaaaaaccctccctttttattgccaggaaaaacctacaagagaaaaaccatgcttggagaacatcagagattcttttggctagcagagtttgtagttttcagtctcttaagggatatttcatgttgcccatatacaagcctcagacgccccattttgctcacatgcaatagaaaattaggccatttctgttccagtgactcagcaccaaagaagtcatccatctcagatttaaaattaactgcgaaatgcaaaagagacaactcagtatagggggagtgaaagaagtaagatattttgcaagcttaaaaacattttggaatgaaaatcatccttgtaaagctggaaactagaagaaaattctgccaatttctttttgtaaaaaaaatgtatcttgaaacttttaaggagtattttatcaaaggatccattcccagcaatgttattttgaggatctatttgataccagctgacatgcttctatttagcatttcactgacttcaaaaatcacagcacccaaattacaggctctaactgaagaagggagtaggtctgtgagctgagtttgattaatgtattcacttctatccctgtctctttcttgcctttgataatgagtgaaactgctgcatgagttactcatttattttggaagaaaagaaaaggaaaatggggtttggtggctcccaggtgagctgactcttcatgtacgtcttccttgtggtcatccgcattgaagcaggtcactgtacactggccaggcttgtgcagatgacttatgaacctggctggtctgctttagatgaaagcatgatggtgcaggaggtcctgtggtccttctcacaaatggcgaggaaaattcttcaccagatgagtgtagcctgagatgcttttgtgaaggttgacatctgcttgtgatgtgatgtgatgtgatgtgatgtgatgtgatgtgatgtgttccttagtcagtttccactgagggcagataaagaaaggctgtattagtctgctcttgcattgctataaaaagcaaattacctgagactgggtaatttataaagaaaagaggttcaatgtgctcactgttctgtaggctgtacaggaagcatgatgctggtatctgctcggctgctggggaggcctcaggaaactttcaatcatggtggaaggcaaaggggaagcaggcacgtcttacatgtccagagaaggaggaaggtggggaggaggtgctacacacttttaaacaatcagatctcacaagagctctatcacaaaaacaccaaaaggggaagtctgcccccaggttccaatcacctcctaccaggccccacctccaacaatggggattacaatttgacttgaaatttgggtggggacataaacccaaaccatatcaaagtctcattttttcaagagagagattcgtttatatggtgtcttcaaacagggacttcttttcctaagttactccacagttgacccaactgaggaatccctaatgcttcctcttgagctgaagcaatgcattctcctagagatctgcatggtaaccacctcttcaatcccatccaaggaaaccctgacccagtgacgtgacctgcactgttgtctggaaggactcatctgggttcaggtgtttctgtggttaaggttctcaaattgggatctttcgtgattacctgtgaatacttcaatgaggttaaaagtgtaaccagatgcaccaggaatgtgaaaggaatattttgtatttttcaatgaactatccacagctaatactttttatcttcaatcagtgtttcccacgtgagaagccagcaccaccaccttcatcaatatcaccatgactttcatcgtcatcaccattacaaccaccatcattaatatcaccatcaccttcacgtaactacctccacaaccaccattctcaatatcaccatcaccttcattaccaccactacaaccaccatcaatatcaccatcaccttcatcatcaccaccaccacaaccaccatcaatatcaccatcaccttcatcaccaccaccatcatcatcaatatcactatcactttcatcatcaccaccagcaccacaaccaccatcaatatcaccattaccttcatcatcaccatcaccttcatcaccacaaccaccatctcacaatcactttcatcatcaccaccaccataaccatcgtcaatatcaccatcaccttcatcatcaccacaaccaccatcaaccatatcaccatcactttcatcatcaccaccaccacaaccaccatcaataccaccttcatcatcaccaccaccacaaatcaccatcatatcaccctcactttcatcattaccacaatcaccatcaatatcaccatccccttcaccatcactaccaacacagccaccatcatcaatatcaccctcaactttattatcacctccaccatcagcagcagcatcaacttcatcatcaccatcaccacctctgccatcagcagcatcattattatcttcatcatcatggtttcagccacaatcggaatcaacagccgtcacccagagttgaaggaggtaggaaaatgcttttgtaaagcacacctcaaatgaaaaaaaaaaaaagcttattgcctataaatcgaccatggatttcttggaaataatttctaattcattcaagattttaagcatgctaactgctttttattatgaaaatgctgcaggctacttttagggaagggcaagaacacagggtctaaaaatggtcctagttaatggtgaattttgaaataaatcgatgctatgcttgatatattctgaattttatatgttcaaagtggatgggagaaaaatgaatcacctgtagagaaaatatatgtgaattctcagaggacttttaaaaagtgagaccacttagatttgatacaatttgagttgatccaaatcctgccatgtcacagggtttatgaagccaaatcaaaagagaggggaaacattcacctgtgttaatattcatgcatttattattgttctttctcttcataaagtagagaatttaaaggttattataaagctctcccatgaattattctgtccagtaaaagtaagcagctgctaagggggagagaaataaaactggaaaacccaagtagtcctatgaaagaaagagtgtgtgactatgtcagattttggggtgttttcctttgctccaatgaccattagaaattccaatcgaagtgaactcaacttagaactcatttatgcctaaaccaaaccacatcttgcaaacctggaaggtccccaaattgtttcaggttgaagctatggggagtgtctttgcttgggttctcccacaagcagagcctgagtcaagggcttgggttcagatagattatggaagcaatcccaggaactggaatggaaggactgggaatagtgaaatagagaaagagaagaagctaatacaaggatgcattttgagttagttactgtgtggcagttttaaaatatggctgcagatgtttgatgctcctccaatctagaggtgggctctatgccccctctcctttcctgtgactcttccggctagcaaaagttatgctatgtgattttccaaggcttggtcataaaagatcatttagcttccatcttatttgctaaaacacttgctcttggaatcctgagctaccatgcctgaagtctgccatgctgggaggaagcccaagccacgtgaggaggctacatttaggccctctgctggggagtcctagccaaggctaatctgtgagccattgcaggcagacattacacaagtgattgaagaattctgtcatgattcaagcctctagtgatttgagttgctggcagtatttcaactctttccagcagaggcctcacacacattagggctatgtcttatctgattttctgactcacagagtcaacgagcagaataaactggttcttgttttatgtcacaaagttttgaggtggttggctatgcaccaatagacaactgggtacacaggtggacaactaggctcaatccactggagaccctctcagaaaccatgtagaatgtgtccctcattgtctgctgagacatcaagaggggaatatttgaatatttgccactgactccagactccctccctttccaacctggcactgtttttatttattttatactttgcatggactttttctccagatatttgcatgactgtatcatttactccctaagatccatgtgcaaagtttgcctcctcaaggagcccttttctccctattcctgttaaattgcatcctctcagccttcttctccttcctgctatattgatctccatggcactcatcaccctctaataaactataacgtttccttattatttgggttacttctttcttctctttattagaatataaactctgtgagagcagtaatgtttgtctgtttgctcagtgatgtagtcttggcccctagaaagtgcctggcatagagtaggtactccatagacacatatggaatgaaacaaacatgaagtgaggtggagaatcctgggggtgagggagaggaaagcctggtggacaggtgtcaggggaagtttgctggaggaggtaacagttaagtttggcccagaaggataagaataggctcattggctgaaggtgtggcagaaagggtatcccagatggaggggacatctgtgtacagaacttgccacacacgagaaacttaaaggagaccaatgtggagtggtaggaatgggggtggggtagtgacacaagatgagactggagagatggcaggagtgacattgtacaaagaaagatgtggctctttgtaagagctatgtcataggaaggaggaaagcatttgccagtttcctaatagagcaaaacatcaagctttcttctatgcccaagtgtacccaagacccctaaaaggtttgcctggagaggaggcacagtgactctacgtcatccaagatcccctagaaatgcatactcaacttgatcacttaaatattcaaataacatttcccaattatcttctcttttgagacagagtcttgctctgtcgcctaggctggagtgcagtggtgtgatctcggctcattgcaactgctgcttcctgggtccaaatgattctcctgcttcagcctcccgagtagctgggattacaggcgcccaccatcatgcccagctaatttttgtatttttagtagagatggggtttcaccatgttggccaggctagtctcgaactcctaacctcaagtgatccacccacctcgacctcccaaagtgctgggattacaggcgtgagccaccacgcccagccaaataaacagaatttcaagccacgtattttacaagttaaaaatcccaactggcaaagaaactctcagttctttttatcccctagccgaacaccgtgacctctttacagatcctaaatgttttactgaaaaaatatagtgacctcttccaaatgcatgtggtcaggatcctctcaaaagcctctacgaagacgtggatccacaatgaagaggtctgctcgcccctctgccgctcagcctgttcctcaccagagtcaccgtctctcctctccaggcaaaggttggaggggccttgggtatagaagaaagcttgaaaggatgtttatatgaggtcttagaggtgaagtcctcaaacagtagactccagcatccagatctttcctaggtttggtctctgcattaatcaggaccctagattacaagtgacgttttgctctattaggaaactggtgagtgctttcccccttcctatgacacagctcttacaaagagtcacatctttcttcgaaatctgagactgggggcttttctacagtggcatgagttaacttgggactgaactgtcagagtgttccagcccttttggccacagagactggctcaatgagatagccaaggggtccagtcagagccaatgagacttagctctcccatggaaactgagggatatgaaactcacatctctatgggagttgctggatctgccagaagccacgccacgccacaaagagaggctgcccaagaatggagcccacagaggggaaggcagacctaaagatggggaagaaggctgcctagacctagaacctgaagttaaccatacctgaaagtctatatttggagttttaaaaagatatgatgaactagcaattgtccattttatttgagccatttgatttgatttctgccacctgtaatctaaagtcctgatgaatgcagggaccaaacctagaaaaggtctgagatgtgctgatgggtgccagagtcggctgtgcaaggacttcagctctaaggcctcatagagaacatccttgtgatttaaatgacatatcatcttttaattggggctgatttaagctttcattttaacattgttccaacttctgcgggcctcagtttagatcacggtgtggtggttgatcccctgatgctgtgtaagccgaggactggcttcctgtgaataaggaggcttcccaggctgaaccacacccgaaactcatcagcctctttttatcatttcctgaaagaaaaaaaaaaaggaaatgcaaaagacacaatagttaatatttggcagaaacagatacattaaattaaaatttaaaactttgattttttggaaacttcctatgaatactgtttggtttggactttccttttgtgtctacacttttccttctcattacaagttcaaaatgttagttctggttcattttttatttcttcttaaatactggctttaattcccggagggtcccattgtctactaaagatgtttaaacatgatatgtttgaggttacaaagacactttgagtattttcttaaaaattcttttggttttggcaaggtttagaatccataaacacactctgttctgcgttcttttactcactatttacctatttctttataaagtggtgattttccttctgtttgagttacgttcatgctcctcattcgtctcatagtttgctgtcatagggacaaaaaatttatttccaaggaaagaataatttatatgtgtttccccaatggcccctaaataagtaaattccatcaatgtatatatctggtattggtgtatgaaatcttttattcagagacatacaaatgaatcttggcaatagaacgtgtataatacaatcttggcattacaaagtgtatatcataagggaaaagaagatgtcaagcattcgtatctttcccaccagtggtttccataagccgaagccacaaggatcaggatcgtcatgagagaaagatgaggcaggattttggcaccaaatttcctgtggttggaatgttgcttaaagtgagtaacaactcgctgctttgtgtaactgtatatgtggagtaataaaggcagccttctgttatcagtaatagagatatttgtttaaattctttttagcctgggaaaacatacaatgatcccacatgagcctgagactcttcctggaggccaactttctagattttgccgggaagcatcttgaggacctcttgccttgtggttgcaacacaggaggcagcattgattctctgcctctgtctttgggtcctgcagggcaggcagctgccaggggctggtgggcgcagccccagcagggtgagcgcatcatctccaggcctcccctaagagacaacctgagcttcactttgccaggtttccactactctggttccatccagaactgaccaggaattcgccaaggacagccagctcctcccacttggcaaatccactatttacgtccagggcaagtcctccaaaggccagggttaaccaggaatcatctatctggccagaaaataaatccaccaggttcttcggtccacctctttggagaaggacccatggaagggggtcctgggagcacaacctgccctgcgggctcacgtgtgacccaggaaagttctccacctcctgtgccttttttccccccaacaggaagtgggctgagagaagctctgccttcatagttcctgggaggcatgaactggttgctgcatgctgagcatttcaaactggcacacggtagggctacccatgtctgagttattgttacattggtgattcttatagccaaaggggagtttctagtgctgacttgagaaagttaccagtgcccctgatatggtttagatatttgtcccctccaaattgcatgttgaaatgtgatccccattattggaggtgagacctggtgggaggtgtctgggtcatgggggtagatctctcatgaaaggcttggtgctctctccctggtaatgagtgagttcttggtctgttaggtcactcacgatctggttgtttaatagagcctggcacctcctcccctccctcttgctctctctcttgccatgtgacatgcctactttcccccatgatcggaagcttcctgaggtctcaccagaagctgaacagatgcttgcatcatgtatcctgtgcaacctgcagaaacgtgggccagttaaatctctcttctttatcaattactcagtgtcaggtattcctttatagcaacatgacatggactaacacacccccaaagggggaatgtagacaaagtcttggttcttagaaggctatttttgtggctaacatccagcatcaaataatgtctcaaaaatttaaataaacaaaaaaatatttaaagtcatcctgtccagagaacatttgaagaaatcaatgaaaatttggggtctcatctggatgttgaaagccctctttctcctttctcatttttttctgtcatcctctctctcattcattcttcctttctccagctttcattctctctctttcttcctgtctctttctgtcttcctaattgcacttacaagatgactcagtctctaatgagggccctgaagtctactgagaagtaagtataacagccggagtaatgaagaatgtgtccttgattatatcgggtatctggaatcttgacatttgtatgcagttaaatttatttccagtttacagcctgggcttatggaggggactggggctaagaaagcacagccttgttcaaatgcaaatggcagtcttgaaggaccctgtaagaatgccatcctctaaccattctccctcctgcggttgagggtgccactgaggatggtgaggagcaaggtgctgtttgaaggaattgctctgttcctgccagtttccttcataaatcctgggctcagctctgcccaggcagcaccagatctgggtcttatgctgttccacggtctgcctggggctcagtccctgggtcgggactggcatatgggaaccaggatgctggtccctctgtacccatggcctcctgtccagaaggcccttgggagggcagcctggagggtcagtcattggcgcctctcaggctttcagatctggcaatttttcaacaaagccaccaaagacccagtgtccccttcccagttggtggtgccaccaaatgcccggttcctcaagccagtgagcagacagcatcctcaggccctccctcatcttctagctgccatggaatctattaaattgaaaatgcacccctgtctgtccactcctctccacaccctgctgctgtccccaagtctgcacctctgtcctcacctgggtcactacaacagcccccatgggccctcctgctcccactcctcttcccatgcctgaaatctactctctgcgtgtatccagagtgagctcctgaaaatgaccatgtggccctgagcggatgtttcagcggctcacactgcactgggaacagcagactccacctcctcatcacctcccacaaggcccagcagagtcctgctggttccccagatcacttcccaccacctcccctcactcccccatcccagccgcactggcctctggctcctcctcccacgccccagtcctcctgccccagggcctgtgcacctgctgctcctgcgttctggaatgctcttcccacagccgccctctgacctgcaccctcttgccctttgttcttcacccaggtgtcacccactcagagaacacccctgaccttcccaaggaagccctctgcactccgacgccatatacccgtgatctgcacaggactgtcaccatctggaattgattgcctctcttcccgttttgctattgtcatttgcacccacaggaatgtcacccacatgagtgtggaatttcatctgtctgttcgctgctggatccctgctctaagtaagaaaaggacctgtggcagagtgagctctggatgaggatttgctgaggaattgaatgagggaaagactcagagaatggaatgctgagaattctacaataaatatttgaatcctagagtgttggagtcaggagaagccctcggaagccatctagacaaacccattcatttgcaaaggggtaaactgaggctgaggagaaaaaagtgacttgctccacatcccaaggcctgagggtcttctccctgctctgatgggagagggaccccctttgtgctgttgtgggtaaaatggtgatgtgtggctggagggtgaaggggcttcttctgccctttgactcattgcctaggaaaatagggacaaaaggcgcaaattttttcaaaatgcaaacaactaaagacaacgtcattcagtagagacaaagtgggtgtttgggttgacagagaaacagaaaagcttccctgaggttgaggagggaagagggggcttgaaggtgggtgagccccaaatgtgaccttcaactcctgggaagctgtaggcaaggacatagccaaggcaaaaccatcaagaatgtaattcaccaacagaaacattcactgaccaccctcggggcctgaaggtctttccaaaggtgagtcagagtgggtgcttggatgctgatctggggaaaaggggaagctgccctgagctgaagagtgtccctgccaaattcatgtccactggaacctcagcgtgtgacttagctgaaaacagggccctgccatctcatactgtcctcctcggtcacactggctggaggcaaagccctctcccctgtttccggaaatctccaaccctgtgcaccttttatcagtcttcacttgggtggatttttctgttctctagagctcaactccaaccgcccctttgccaaagggcttccttgagagctgttctggcagccgaggctcctccctctcctgctggaggtccagggtctgtgggtgtacagaggggcagcctggcgagggcagggactctggatcttttgtcctctggtgtgtccccaggacctagacccggcctgacagtaggtgctgcactactcctggtgaatttattgttagaaattgacaggtccttgctattcatgtctgtttcctccagccttgctgctgagcacatgatgaacttcaaacaatagcgaagtcaggagccaggcgctgatgacccccaggaggaagcttgcagaggatgatgggacagagggggatgggcaggagtctaagcaggcgctcagggaggccgctttcgtcaaggatgctgaaagaatgggggtctcatggattctgggagagatggtccaaggcagagggacagccagtgtgggcctggaaagatgtgtgccgcatgtctgaggggcaggggccaatgtggctggaggtagatgggagaggaggacactaggggctgaggtcagaggggacacaactggatctgtgcgagaccttgcatgccactgaaagggcgctggctgtcactgtcgtgaccagagcctctgggcaggtcttcacagaggtcaggctgactgcacttgcggatggattgaatagcagtagttagaggacagcatgcatggctcagggaggattcccaggatttgggatgcacagctggaagaagggaggagctcctgaatgaggagtgggaggtccgggaagggcagccttggtggggagagacgccgggacctgcagagaaactccctgaaaagaacagggctgagccatctttaccccaggctcaggaccttccttcgctgtaactgccaggacaatccactgtgctgtcactcagagagcgaaaccagcctgactttgcacctgtgtctccaagggataaaggtcaatgtcacagcagactccactctgatgctgtcttcaagccaaaaccttaatattcaatgagaaatctgcattgatgaaattttcattaaacaaactttatccctctcactcctcttgttattcgtggctttaagtatcaggctaatttaggcttgatgccccagtgatctgcagattggagcattattaaacatttagatgagcaatgatgagcctgagcctccctctcctctctcagctggagcacagggggctctgctaatgatcacaatggatttggggcagacacagcaattagagaattatctatagtttgagcaagatttgacccctctgtcttcaagggaaattagctgcttgacttacagagcacacaatttaattgataaaatgtatgaaaagaaaattccagccttagagccagttttacaactaacaagctgtgcaaatgcctgagcagacccctctttctttctgtacctcctcttgccccatccgtagagtaaggagggctagaccagggcagaggcttccacatgtgggctgtgggctgaaatcagcctggagaggggctctgtctggcaaactgtttcatttgtttgtttagtgaacactttcctagcactcatgattttgggttctgtgtgtttcatgtatgttaacttgtctcattctcccaataccccttgagataggcactcttattattcccattttagagatgggaaaactctgaccaagaggggttcaatgccttactgtgggtcatctgctgggcaggagtaaggcagggtttggacccagatggtctggttccacagcctatgctataaacttctgtgccaaactgtttttattattattattattattattattattggaggcataatgtttaaaatgaaattgtcagaaatttaagtgtgtgtgttcttgacatcaaacagcttatatgttacaataacggagctctcccaatactcagtccgccttcctatcttgccacaggcagctattaccaacgtgcccttagggtggaacattctcctcctggtctacctcagtccctccagtcctagagtctccccatcaccacggccaaatatagctcatctttgataactgaatttaccctcttgatcatgcttggattgcttcattgtttgacttacctgcttggtgctggtaggcatttaggagttgtttgaaggcatcagaaagcaacccaggctgccaggacttgagggtccacgatcccatggaaaagcgaactgcaacgaggtaagccctacattctccttgaagctagtagccttgaatctccttgagctagtagccaatttgtaagtgcagaggggttgagaaagcagaaagcagtggctcagagttgtatgccaagttcacagatctggggagacgaaagttgacattcaagctgacaagaaagccagggtttgagggacagagatgtcagagaaaatgggacccctgacagtgagtctgaatttctgtatcagtgtttgctgatccagaatgagatgctcagaagccgagctgaaagtgggcccccaaaagctaagaaaccaagcagttttcatcaatatcatgatgccgtaacaacaaaaattagggtttaagactcaacaaacaggagttctggaaaatatgcaagtctttcagttgaggtcctccaaggaattgccctagaagaaagatcaaaccaaaataaagtaggccttataaagacagaaaatcagccttaaattaccttaatcccagattgattaaggtaatctgtgcctaccatcgtggttgacagaagaatttattctctgggaaaagatatcaagagacactcagtttttcaaataaaatagccagaagtcataaaaaaaagtcatcagaagtattaataacaggagcaggtgcaaatgaccaaaaaccaagcaataaaaaaaatagacaacaagaaaagacccacagatgattagttactgaaatgatcagatacaaactttgaaatagcaattagtgatatattaatttaaaaaatgaaaagctggaaaatttcatcagaaaaatggaatttataaagcagaatcagatgaatagtctcaaactgaaaaataaaataactaaaattgaaaatacaagtgataggtacatcaacaatttagacaaagcaggagataggtgtgttgaaaatctacaggctgaggtatggcataaaaactttgaaaatataaaaaagagcatcagaaaatatagaatatgatgaaagatctaaatacacgtaattgaaattctaaggctgggtgcggggactcatgtctataatctcagcactttgggaggccaaggtaggtgaattgcttgagcctaggagtttgaggccagcccgggcaacgtggtgaaatcccgtctctatgaaaaatacaaaaattagcatagcttggtggcaggcatctgtaatcccagctactcgggaggctgaggcaaaagaatcacttgaacctgggaggcacggggtgcagtgagctgagatcgtgccactgcactccaacctgggcgacagagtgagatcctgtctcaaaaaacaaaacaggaaacaaattctacagaagcactatatgaaaatatattagctgaggattttccaaagctagtgaaatacgtgaaatcaaagattcaagcactcctagcataataaaaacaaggaaagatacacttcaccacatcatagtaaaactgccatgagtgaaagacaaagggaacatcttaaacacaaccagagaaaaactatacatttccttcaaagaagaaaccataagtaaacggcgaatttctcaataagatcgatggaagtggaagataacagaatgacatagattcaactgctgaaaaaacataattgcctgtctacaatcttatacccatcaaaaatatgctttgaaagcgaagatgaaataaaggcatttttagagaagtgaaaatcgacagactttattgccagcagatctgcactacaatgaacaccaaagagagttcttcgggcagaagaaaaatgattctaaatggaagtgtagacgcgcaagaaggaacggagagccacagaaagggttaatacattggtaaatttaatgagtacacaaaacaataacaagaatgtcccgtggggcttaccgtatctgtagaattagatgatgtgacagggatgatgcgtctatccaggaaaaatgtttaatggtgttacagtgctctatggttcctcattgtccaggaagtggcaagactctaatttagggcagaccagaatgactggaggagatatgttataatccctagtattacagtgaaagaataatgaagagattaagatgaacgagttaattggaattgacaaaatggaataataaaaatactcgataagaagaaataaggcagaagaagagaaaggtgatgcaaatcgaaaacaaatagtaagaaaccagacctaaattgtatgaataactgcattaaatataaacagaaagaccagtcttatttttaatccgtagagataaatgggtctgtttctcatctactccaaaatatttccaaggtagatgtgtgtatgaatcccctgaggagcttttaaaaatgtttaattctctgagcccaatttcagtagtttaggggtgggatttgagaatctgcatttttaataagactcagaccattcctggagaaacagtgacctcgcctgtggaatgggagggatagggatgaggggtaaactgttcacagaccgctttagttgttgtggagcttggagcttagcaaggggctggtacaaaaacacaaatcaacgcaatgcaataaattgtgaaagaattgtcttctaggagggacctctgttctcctgcaaatggcagatgagaggagtcacaggttttctctcctcttaattattcagatcttggcacctgaggagcagaccagctggggttaggaatccaaagcagggcaggatccgtccacacactcgtgtgtttatttatttatgcagctccagcaaagaaaattaaaaacagggctggcccctggctgggagatggagcctgacactgcatatgcgtctgtgagactcagtctggtcccggatgcccgactcctcgaggtctgtctgtgcactgggccaaggccctgctggccacagaacataggcggtgagggctgcatagggaggggctgtggtttcagaggctgacgcagctggctggccttctgctccttgtctcccggaggctccctgccctcagcaatagaaggtaagacaaggatcacatcccaaggtgggagggggctcgtgccagccctgaaggtggttggaaggtctttttgtagcagccaggaagggctggctctgcttctagatccacaaagctgcttggatgggggccgtctcaggcggagggccacgagggctgaggagtgcaggtctactctgcctcgggctgcccaggcgacatgcccaggggtctgtgtttctcctggagcctgtcaggtttgggagcacccagtgtggtggcccaaggtccgaggtccaatctagggaggcagtggtgttggtgaacctggccatgctaactttgcttaactctaccaaaaaaaaaaaaaaaagaaaaaaaaaaaaaggaaagaaagaaaggtgtggtaggatatgggtgacttctctcttttgtctttttctgtttttaagttgatagaatgtttttgtgttttgaacagtttaaattaagcaaaaagtacagaacgttcctataaatcccttcaataccctggtccttgccactttcctctatattaccatcttactaaacatttgttagaattgatgagtcagggcagggaatttaggggtggattagtaactgctatggagaaaactagggaagtgggaaaagttcaaagtcattattcattttcgagaaaacaaaaacgaaacagaacaagaaatgtgtaaaagaaagatgattaaattttatacctcatggctcagttgtggatgcttttacccacggtggtgtaaacactgagcatttctctttctccagctttctggaggtataattgacaaataaaaattatatatatttaaagtgtgcaaagtaatgttttgatgcatgcatatgttgtgagatgaatactacgatcaaagtaatgaacatatctgtcacctgatgtagttgcctttttttgtgtggtaagaatacttaagatctattctcttagaaaatttcacgtgtacaatattgagtataaatatacagtacattattcttaatgagagtcaccatgctgtacattaggtctctgaaaatgtgtaccctttggactgtctccccatttttaacgtctttctccctcccctcccctcccctttccttcccttccctttgacagggtcttgctctgttgcccaggctggagtgcagtggtgtgatctcggctcactgcagcctctacctcccaggcacaagcgatcctcccaactcagaatcccgagtagctgggactacaggcatgtgccaccacacccagctaatttttattttttgtagagatggggtctggccatgctgcccaggctcctctatatttcttacatatgtgaaggctcgatatggctctcccaggaagatgggcaaaggggaatgtgtgaggggctctggtctgagaacgaaatcctcatgatttttgcttcacagccagtagacagtaggtaataactagaaaaaagagcaaatagcaacctaaacatattactcagaaatgaggtgatactcgtagacatgctaaaattgctgaaaatggttgttcctggagagtagtagtgggggttggtgtgggaaactgcagcttttcattatcagccatgtaatcctattaccctgtatgactttgataaaaatttgaaagaatatgtatttttggtgtcgatttcatatgtaaatagatgcctctgagccagagtcagccctcacacctctctctgtccttcccacccccaacctggtagcaaatcctgtcggtttcactgagttcacctcttagcatgccacctctcccgctgtggccctaactgccatcatctcccgttggattcttgcgggtgcctcttcctgggtctccttgctcctccttggctgcagactgccttgcagatggtctattccccacagagcccggagggtctgccaacagtggagtcatctctgccactcctcaactcacagcagcctgtggcttgtctcctcccatggagtaaaagccaatgatgttacaagaatccacaaggccctggagggcctcaccattcccctcacatctatctgtcctgcagcacaatgctggtccatgcccaagagagactgtgttgcctggaacacaacaggagctcagcacagccgaggctcagggcagaacacgcttctcctccgacagagcaggtgttaaggaagtgcctgctattgcggtcactgtgaacattattattctagaatatgagcacattgtgagactcttgctgacttgtttggtgttttgtactgttttttttttctttttttaaaaattttcatttattatttttgcttttttattaaaaaaatttttttttttttttgtagagatgggtgggtgtggtggcatgtgcctgtagccccagctacttgggaggctgagttgggaggatcacttgtgcccagtaagttgaggctgaagtgagctaagatcatgccactgtatactccagcctgggcaacagaacaagaccctgtctcaaaaaaaaaaaaaaaaaaaaaaaaaaaaaaaaggctgggcgcggtggctcacacctataatcccagcactttgggaggccgaggtgggcagatcacctgagttcgggagtttgagaccagcctgaccaacatggagaaaccttgtctctactaaaaatacaaaattagccgggtgtggtggcacatgcctgtaatcccagctactcaggaggctgagacaggagaatagctcgaacctgggaggcagaggttgcggtgagccgagattgcaccacgacactccagcctgggcaacaagagcgaaactccatctcaaaaaataaaatttaaaaaaaaaatagaagtacattaaaaatggggagacagtcaaagggtacacatttccagagacctaatgtacagcatggccactctcattaagaataatagatctccctatattgcccaggctggtctcaaacttctgggcttggatgatcctcccccctcaacctcccaaagtgctgggattaaaggtgctagctgctgtgcccggcctatactctttcgagtggcagctttatacacacgaagcaggctacaactgctggtttctcatgtatgagggaaacacgaaatgatggagattcactcctcttcgtcaccctagagggtggaactgatacctttaaaggctgtctccaaggaactgggctggatggaactgccacgagggtcacaggggctcaacaaaaaagcccttctgcagccatgctcagcttggggcctggagagctgctctaaggtgccagagcttggttggcagggggcagagactgggtcccacttgtgttagagggctggccccctggggtcaaaggggtgctcccaatatgctggctgggagcgcattcttagctggttctcaggcttcagtcatggagactgaaggaccaaggtggaaagtcaaggagaacgttccagcttccaggctgcatgtccacctgtccacgctgcttatcgtctctcttcttctttctttattaggaaatgttttgtattaagtagagcccacttagagcatcacaattattttatatatttttcaaatcttaattttatttttaaactcacaatgaatacaaaaaatagacttctatcaaaattgaaacaatttgcaagtgtatgggataaaagcatcctcctttcccacaatttcacttccctgctcagtattatttcatataaatagcctatgttcttttagattactttctatgcatgtacctctataaatgtgggcatgcaaagtgcatatatgtcagttattcatacagataaatatatcttttctttcttttttttttgagatagtctcgctttgtcactcaggctggagtgcaatggcgcaatctcagctcactgcaacctctgccttctgggctcaagcaattcttctgcctcagcttcccgagtagctgggattacaggtgcacgccaccacacccggctaatttttgtatttttagtagatactaggtttcactgtgttggccaggttgctctcgaactcctgacctcaagtgattgcctgcctcggcctctgaaagtgctgggactacaggcatgagccaccgtgcttggcctataaatattattcgtcacctccctttttcatgtaatagatgtctgggacatagccctctgccagtgcacagtgacccaccttatttctttaaatgcctgcatagtcacacactgtatgggtgcaccatatattatttaaccattgtgttatagacaactaagtatttttcatttgcttatatattcattcattcatttacttttgctgttataaatattactgtagagaacatctttaaatttttaacgacatcctttgttatgcaaaagttttaaagtttaatgtagtcaactgcaagagaaagacacccttaactgatttaagcaaaagtaaaatgtattgatttatacaactgaaaaactcaggagtgagacttaggtagatttaagggattaaataagccaccaggattgtttatttcagctccattctcctccatgacagagtcattcttgggctctgcaggaggtaagatggcttctagtagctccagaaccatttatgttttaagtccacttaaaatgatttgagcagaataatagaacctcagtctaaaaagtggcttagttccccctttccccatcccaccccacacataacgagaagcctgaaggtaagtagctcagagaatgactcagtaactcaaaacctaaggctctagggagatttctttgtaattccgtgatttattttggtatagccccaaaatggctgccacttgctgtgttcacacaacagtgtccaatgaaggtaggaaagcaagccttttgtcaggcacatctctcttttatcagacacgtcaaatcccccccagaaccctccacctccccaccctacaccccaacagacactccctcagagtccactggctggactgattcatgtgattctgccttccctgcaaaggaggatgggaaagcaaggaacgggcactctcagcctctggattggggaactaaggggtggggagctgttgggtggacatccagcagagcctgacccagggagcatctctcccagtcactcctgctccagagccagggctcactctgcttggattaattcctgccacatgctcatcctgaatcacttccaggtcagagggatttaccagctaattggccagacctggtcacgttttctatccttagatccaaacctggagctcatcttgaacctggtgatgggcaacaggagagtgactgcttggttaccagggtctggttaccagaagatggggcaatgaatgccagaaactcaaattatgaaatttgcactagcaaagccacatgcacttggaataatcattattggtgttcttgtcaatttcagagcatgagtttctggctaatgctgacttttagtaacttcctctccatcactattatcctctcagcagtgaatggtgaaaaggactttttaatgagctcttttccttttcctctgcacttcccttgttctcaccttcccctacccaggcaatctgcctctctggaaatcagtgtcttttaggtgagaattcagggaccctcagtttagaccagtgtcactgtgggccaagttcagtgcccagtaaagccacaggtatctttcaaagtctcacttctagcctttacctctttagatactctgtagaggtagatgtcattgtgaagcataatgacatctctccatcttctacgggcattctacttcaccatcctaaatgcaagccttccaatctgacttttctctccccacgtacccattagcagcttataaagaatcagaaccacaccaagccttgaaatcagtgtgttccagcatgggctcagctataaaaacaatttgagtgctcacagctttaaaatgacttggcagcctgtctataaaatgtcctgtagcctgaaagcgggtgagaacatgcctgcatacattagtgatccattgattgtttctggagctaggtaacctttgtatacgaaaatgagagaacagctgaggcctgatcaatcaaaccagccattaagaatcttgcctagtccataggcctgctccatctcagggttcccagggagaaaaataaaaagaaaacaagttttagccataaatgcggggaataggagacaggtctggacaaaggttgggaaggttgaagatttcattccactggcagtttgtgactttccctaacccactcctgggctaaatacaggggagcaaaatgcaaaatgacattggggttctgagaccacggcataccctgtaagatgattgtcctgccatttcctgcagctgcctatctacaggcaatagagggtgcacatgtatgatcagggcaaataaatacagggaagggggcaggggaagaggactccaaatttgtctcttctcagcaagaggttctctgtgagttcttttgggccaagaaacaaaattcaccatccccagcctaaccacaaactatgactgtgcctaattcaataaaaatatcagatggggagaatggatgtcaattacctggagcttcatattaaacagggagtgatggattattaagtagtattctgtatttaacctcagatatttcagaaattttgaatacaattttctttagcaggaagttcattttaattcttaaaaaagaacatacacttttagaggatatatccttcgtttaaaagtctaatttgggaaacactcatatatagccaagagatttggagggatgttcattgaacatagtttgttttacaaaaatttggaagatgtattagtttcttattctttctgtaacaaatcattataaacttcatgtcttaaaacaacacccgtttattctcttacagttctggagtctgaaatgggttgacaaggctgctcttggggagaatccatttccttgccttttctagcttccaaggaccacctgcattccttagctcatggccctatcctccatcttcaaaggcagcaatggagcatcttccaatctctctctctctctctatttctgttgccacatcactagtttctgactctgtcccctcttcctcctttttttttttttttttttttttttttttgaggcagagtctcactctgttgctcaggctggagtgcagtgacgctagcttggctcactgcagcctccatctccccagttcaagagattcttatgcctcagcctcctgagtagctgggattacaggtgcatgccaccatgcccagctaatttttgtatttttagtagagatgggattttgccatgttggccaagttggtcttgaactcctggcctgaactgatttgcctgcctcggcctccccaaagtgctgatgttacaggagtgagacactgtgctcgttcttcctctaaaaaacaacaacaacgacaacaaacaaacaaaaaaattttattttaggttcaggggtacatgtgtaggttttataatatagataaacttgtgtcatgggggtttgttgtacagattatttcatcgtccaggtattaagcctagtacccattagttattttttcctgatcctccacctcctccaaccctccaccctctgatagatcccagtgtctgctgtttctatgtgtccatgtgttcttatcatttagcttccacttataagtgaaaacatgttatttggttttctgttcctgcattagtttgctgaggatgatggcctccaactccatccatgttcctgcaaaggacatgattttgttcttttttatggctgcatagtattccgtggtgtatatgtaccacattttcattatccagtctaccatttatggtttcatgtctttgctgtcgtgaatagtgctgcagtgaacatacaagtgcatgtgtctttatgatagaatgatgtgtattcctctgggtacatacccagaacagacgcatgccaccacagaatacatgtggccggccgggcgcaggggctcacacctggattcccagcactttgggaggccaagtcgggcagatcacgaggtcaggagatcgagaccatcctggctaacatggtaaaaacctctatctactaaaaatccaaaaaaaaaattagccgggcatggtggcaggcacctgtagtcccagctgcttgggaagctgaggcaggagaatggcgtgaacccggaggcggagcttgcagtgagctgagattgcaccactgcactccagcctgggggacagagcgacactccatctcaaaaaaaaacaaaaaaacaaaaaaagaatacatgcggccaagaagcatatgagaagaagctcaatatcactaatcatttgagagatgcaaatcaaaaccacagtgagatatcatctcacaccagtcagatgggctactattaaaaagtcaaaaacgacaagtggttggtggggtttcagagaaaaaggaacccttatacactgttagtgagagtgtaaattagttcgaccattgtgaaaagcagtgtggtgattcctcagagaccttcccccgtcttataaggatccctgagattacattaggcccttgtggacaatccaggttaatctttccatcttaatattcttaattgtatctgcaaagtccctttggtcatgtaagataacattcacagattctgtggattaggatgtgaacagctttgggggcacaattattcagtccaccccaaaataatttacagcagtcagaacagcctagcttatgccacagtaataagcaccatgactgggcacgctggctcacgcctgtaatcccagcactttaggaggccaaggcaggaggatcacgaggtcaagagatcgagaccatcctggccaacgtgatgaaacctcgtctctactaaaaatacaaaaattagctgggcgtggtggtggtgcgtgcctgtagtcccagctacttgggaggctgagacaggagaatcacttgaacccgagaggtggaggttgaagtcagctgagatcacaccactgcactccagcctggccacagagcgagactccatctcataaaaacaaacaaacaaagaaagaaaaaaaacaagcaccacaaaaataccaggggcttgaacagctaaggtttttaatttttttatttttttttattttttgagacagagtctcactctgtcacccaggctggagtgcagtggcacgatctcggctcactgcaagctctgcctcctgggttcacgccattctcctgcctcagcctcccgagtagctgggactacaggcacccgccaccacgctcgactaattttttgtatttttagtagagacggggtttcacagtgttagccaggatggtctcgatcccctgacctcgtgatccgcccgcctcggcctcccaaagtgctgggattacaggcgtgagccagcgcgcctggccctgatgttgtttttcactcatgctgcatgtgcctcaggtaggtggggcttctgctctacgtcatgcccactcagggatcctgtagagggtgactttctcttcatgctcctgtgacagcccaggcaggacaaagggcacctggaagatcagggactgcctcttaagcttctgcctggaagtgacacataggacttgtgctttcacttcattgctcaatattaagtcccaagatcatgactaccttcagtgcagggcagagaagggcagttgcactgccacctgcccagagggcagagaatcggaactagttcacaaacgtcctcatgaccactcacagcctaagtgtccatccttaggggaaaggtgatatgaactagggtaatatgatttggctctgtgttcccatccaaatctcatgtcaaattgtaatcctcaatgttggaggaggggcctggtggcaggtgactgaatcatggggacagacttaccccttgctgttcttgtgattagagctctcctgagatctgcttgtttaaaagtgtgtagcacctccttactctctgtcttctgctggccatgtgaagatatgcctgcttcccttccgccttctgccatgattgtgagtttcctgaggcctccccagaagcagaaggctgtgcagcccacagaaccttgagctgatcaaacctgttttctttataaattaccctgtatcaggtatgcctttatagccgtgtgagaacgaactaatacatgggggttagctccagacatagacacatacagaccacagcaggtataagggaggaggtatctgtatgcagcaaggccgacaggtctctagtgcatctggttgaggggggaaaagcaagatgctagaccatatgtgatgtgagaagccatctatagaaacatgtgcatacaaaaatatggtcttgtctttataggcacacaaataggtagaactggggaatcaggtctggacaccagcacactgatatcaacaccatgggcagttatggagggggtcaggcccaggaaggagatgatgaggggggactttgctcctgtttatagcgttttgatcttttaaaatatttaaataattaaaaagttcctctgtctattatatggggagaatgcattagttattgtctgcaattgtcttaccaaaggtagaataaaattactgataaggattccttaggtgtgggagtggggagaatggagggtgagctggagaaatcaccaaagagagctggaggctgagctgttggtgtctcagaataacagagataaaaagatcctggggcattatgttgctccatgattcatttgcttgcatgtcaacagtggtacaactcaggcctgagaaggagtgacctactcaaggccccagggctagttggggaggaagccggggagaatgtagagcgcctaactcccattccagtgctcctcttcccaccagtagccagcctggacataggagaggagccaggcccaggcttcagctcagtcccttacttgctgtgtgtcctcaggcaagtcacttcccctctctgtgcccagttttattttttcatctacaataaggtagagttgtaagaattccctgacatcctcctacaaactacatcaaactaaatgtagcttgtgagagctattttgcacgattttgtaaagaattaaagtaatgatgttattattaatgtattaatatctaggtattaattataatgaaatgattatcatccttaataattctgttttattattaatattagtgataattattaataacctacataaaaggatagcataagctttaaactaggataaaagttctaggacaagctgggagtggtggcttatgcctgcaatcccagcactttgggaggtcaaggcgagtgcatcacctgaggtcaggagttcaaggccagcctggccaacacggcaaaaccctgtctctactaaaaatacaaaaattagcagggcatgctggcagacacctgtaaccccagctacttgggaggctgaggcaggagaatcgcttgaacctgggagggggaggctgcagtgagccaaaattgtgccactgcactctagcctgggcaacagagtaagaatctctctcaaaaaaaaaaaaaaaagttctaggacaagaacactgacttctcttgttcaaaccatcttgttcataaacctacctgtggcatgaccagactcggaaagtgagggcatttcctgaaggagccaactcctcatgccagggatcttctgaggtgcctatgtctgcagcattgggagcagctgagactcaggggttcagcaaagggctaaggtgaattctcctgaaccctgcaggtctcactgaggacaggctggtgccagatcctgtaactgggagagccttctgccagcctctgaccatggagttaaacctgggaggggcgcagttgtccaagatccattttggggatttaaaaatttctgtaatttcatgaactcttccaggaacaagtgacataaatatttttctctttcttcctctcttttaaaaagtgctgcttgtgctttgtccccaccttcttcctctctacgcatttgggttttcaggaaaagctgacctctcatgacctgcagaaaatttcttttccattatcccatgaattttgcatcatgtgacattgtcactgagcaatgacccctagtatagccttcacggtgcctttgctttggctgacactggctccttagacggccgttcaccccgccctgggtctggggtgggatgtcaggaaactaggtcttcttggcacccccaagctgcctgggcatcaacctttcagactcctcagatttagggctcaaggaatggcccagacatcagtgtctgatgatcaaacaagccaacagcgggagggaaaatgatcctttcatagaagcaaacctgtcagtgggatggggccggcccctgagctcaggacgctggggcttttgctgtgtgccgtgggcaagaggctccctctgcatgcctggttccctcctccggaaagtaggagagcggcagtacccaccccatggggtggacgagtggcttccctggagcacgcgagtatccagccagcagagccctgtgtgagaaagtgccctgtgtgtgtgtggcctggaaacccccaagtggtctagtctcctgtggattatggaccctcctgcagcccctaaggcagtcacgcttcttatgaatgttgttccactttacagactggggaaaggtcagggggcgggccttgtcaaggtcacacagctggagagctggcagctggatttcaacccaagtccctgacccaattccacagcccttgattttaagcaaacacacatcctctctgtggcaccatcactatccaagaaatagcagagtcaggcggggctagttggacgccctctgatctatttatttttcagcgtctgcttcataaacccttggacatccacctgaattttccttattgctgttaacctcatcttccaattacgcaaaatgtttcaaccaattagccccttgttgcaggagtctcatctttggctgacatttggtgctgtgtgtcttggtcctgactgacaaaggcagcacagcaactgctcatgtcagcctcgttttctccaaagggaaaagggctccatgactagtcgggcatctgggggacccaggagctccagtagctgctgagcaggcaaagaaaggctgattaaaacccacacaccaaggccgggctcagtggctcacgcctgtaattctagcactttgggaggctgaagtgtggatttcctgagctcaggagttcaagaacaacctgggcaacatggtgaaaccccatctctactaaatacaaaaaattagctgggcgtggtgggacccacttgtagttccagctactcgggaagctgaggcacgagaattgcttgaacccgggaggtggaggttgcagtgagccgagatcatgccactgcactccagtctgggtaacagagtgaaactccatctcgaaacaaaacaacaacaaaaagcacatgccaaggtggaaactatgtttcatggtttctttaaaaagcacaaagattgggaggtgctaacgacacagtctgataaaactctgtggttttggtgttttctgtatatagacaccctgaggttcacatgtcgcctttcccttggcatttaaggctccaaggaaccctctgttttgcttggtttcccaattaacccctcattcattcattcattcattcaagaggttactgagtgtctgcaatgtgccaggcactgttcttcactcaaagtctaaagcaggggatccaaaaccaaggttctgatgctatggagctcatgctccggtcaaggacaatcaataaaaagacaaaatgtggccgggcacggtggctcatgcctgtaatcccagcactttgggaggccgagatgggtggatcatgaggtcaggagatcaagaccatcctgctaacatagtgaaaccccgtctctactaaaaatacaaaaaaattaactgggcatggtggcgggcgcctgtagtcccagctactcgggaggctgaggcaggagaatggcctgaatccgggaggcggagcttgcagtgagccgagatcacgccactgcactccagcctgggcgactgagcgagactccgtctcaaaaaaaaaaaaaaaaaaaaaagacagaatgtgtcttgtgtgtaccaggaggaggctgatgctgagtgggaaaatgaagccaggaaggggggttgggtggaagtggggatcctcagagaaagctgtcatggagcagagacctgaaggccacaaaggtgggagacaggctaatatcttggggaaaggcagagggaacagcaagtgcaaaggccctggggcaggagcatgttccagcagcagtgagggaccagtatggccacagcagagtggagggagatgcatggacagagaagccagagaggcagggaggccagacacccacaaagcctcatgggccgctgtgaggatctgggttttatcttagtgactccggaggactttgagggattttgaacagagggaagaaatattattttctttgatattcattttctattgctgtgtaatacatgaccacaatcttagtagctgaacatgacacaggtttattactgtgtggtttctgggggtaaaggagtcaagcatgttagagctggctctctgctcaggtccccacaagcctgaaatccacatgttagttggttgcgtcctcatctaggggctccacttgggaaagatccacttccaaactcccccgggttgttggacagaatcagtttcccttggcgctgaagggccaaagaccctgtgtctttctagctgtcagctcatcaccacactcagcctctggctgttgctcccaggccctcgacacatggtcccctccatcgttccttcccaaagaactcagcttctttcaataatttgcttgattaggtcaggtccatccagactctttcacctttgatcaactcaaagtcagtcggttagcaacctaatccatggcacgatatcccatcagattttgtttctgcccagactctaaaggagggaaggagcaatcatggggccatcttggaatcttgcctgtgacttgtagttagaaagatttttctgaccattgtgctcagaataggataggggagcagctggggcaagtgcagactctgggaaatcagagaggagacggtttccttttcaatagtgatggaccatggcagtagcagttgtgacgacagaagtgtttgaagcgtggttgaagtggttgtaaaatggatgggatgtttttgtaaaatggtttgaaggagaacaataaaacccatacaggttgactccaagctttctggtctgatcaccctgaatgctgagctgtgggagtgtattgtgtttatcgagaagtgtgcagattgccaaaggattcgctttgtgtttacagagttaaaggtagacaggtgctccgggtttgtgatttttaaaaaataaaaataataatacagtatctatacagatgagacttgtcgtcccgttaggatcccaatttgtgactttcctcttttaagagaataatacagaaaagcaaatgagatctgcaatttgatcagcatttgttttttcagctgctggttcctgaaaaaaaattgtagcacgcgagaatcagcgacaataatttgtggaagaattacaaataggccaggagttggctggctttactggttttgacttgaattagatgtaagacagatgagtcgaatgaggtctgttttgcagcagaaagtattgcaatgtcacaaggggccataaaggtgcctaaactgagcagaaacatatgttcttcagaaattagctgttaggtacgagcctttctcttgttgatgctatcggtatgaaatccaatattatcccagggaaaggaaataaggccacttagctgttggatgacaagctgtcttacactccatcaaacccacccgtttacttgtcacacggcttgtaccgctcaggaagataagagacgtcgtatctctgcttttcctcatggtgtgttttggaatagatgccagcttgatgtgttgaccacggtatgcggggccattcaataaagacagatccttggccaaatgttctgtatttttccaaatacaaaagacaaactaataaaatcaatgcagccatgctgaacaccagcacagagggctccctcctgcgctgccacgtgcttcccaccagggaaatggatcagacgcagccacgtggcccgtgctacctgatgtctttggaaaattatgcttttgttttaattttagaataaaagttgttgagaagtcactctggcaatcccctgcccaccaagaacaggcgctatcaagagtggatattgcagaaacgcttcctctccctacaaaccttccagggtaagcatggagggagaggctaagccttctcttcattcccttgccactgtcttcttgacccaaagatgaggggcttccatctctaaatctcccaggcaaaaattctaatagctgagagacagaaagcagctcaaatattaaaccacagatggcctgccatttttgtttgaagggctggaattttcagttaatgctgggggaagtaagaaagtcaactcagttgctctgtccagtaattcaccattgctgggctttactgaacaaaggcaaactctgacgacatgatcatgattgaaagaggcagctgagcaggtgagctcctcctgtggctccctctcagcatcttgtgctgccattgtgtgtttaggtattcatgtctctgactaagacagtgagctcctcgaggaaggtacttgtgcctcgatcatcctagaaccctccacgcccagtacgcacagggccagcacctagcagacattcagtgtgtatgtaagcctctgtcctggtctgaacaggggagtgcccgtgtgagcctgtttgctgccttaattattaatagcattcccgtatgacccaacctatcactaaacctcagtgttgctccctacctaagcagaggaacttcattgcaagaatattgagtggcttaatgacgaggtaatttcttgcctcgtatgatgaaaaaaagtcaaccaggaactggctgagcacacctggtttgcacaaggtggtcctcgtcagtgctggttgttttgctgtaattgtgaatggtgctgcctttcgcacttaacacatgtcctgagttggcgagtaagttatctggtcatctttggcatcatcatcaggcatagcaaatccagcggtcatcagggcatcttagagttggcttagctcttggggaccaaagggatgtaaaaattgccccaggatgtattttactaaggttgtcaaacgatgagttagggtcggctggttttctagtagctttcaaaaagcccgagattaactcagatggaatcagcttaggtcacgtgcccacctgtgataagttcttgttgccggggcaacgctggtgctgataggtttaacctggatcataggtcccagcccctgactctgggatgtttttctctccacactacattggctgggtaggggtggggagagttttctaaatgaaaatcaagttgctgccataaactcccctcactaaaaggcatgtccttttgacatggagatttttgtccattttgttcaatgctgtattttgagcatctagaatgataacactcaacagtggaagctccttaaatatctgttgaatgaataaatactgagaagacaaatagaaagttttcctgaggcagccttctgtataaaataggatacactttattgctccagatgctccgtgaagcagtaacaaactgcaggtaggcaagacaacctccctcaagagaatcatcctttggtgttgaaaaacatattggaaatcactgacggtggcctatacaggtctctcgtatgctgacggtacaaactctccacacatttcaagcactgggcttggtctgccatgttgacagaatcacgatgcctgcctcacagcaagggcagctccctcccacagtgaaactgagctccagaggaagtagggtttccacaagtcagttcagttctctcctttcaatgttgtattcatctgctttatatttctgtaaaggaatacccgagactgagtaatttatgcagagaagaggtttatttggctcgcagttttgcagactgtacaagaaacacaagaagcgtggcaccagcatctgcttctgatgaggcctcaggaagcttttactcatggcagaaggtgaaggggagtctgggtgtcacatggtgagagagggagcaagagagcaggggttggggaggttccagactctttttaacaaccagatcacaagagaactcattaccatggtaggacaccaagccatttcatgagcgattcacctctgtgatccaaacagctcccaccaggccccacttccaacactggggatcacattttaccatgagatttggagggaacaaacatccaaatcctatcaggtgtgaaatgcacatgataggagcattttctcattgagttcatgtggataaactcgggtccatcctgcaagtgttttgaaatcatttacagaagttcctcaagggcaggaattacatcctctgttcctggcatgatgcctggtagccaaaaggggctgtaaactgtgactttggggctgagaaggtgaattcccctacctgggatttgtcagtctctcaaaagagtcatgctgtggtcccatcccatggtaaagactgaacatattggatgggagagaggggtagacagggtgggagttgctggtattggatcttctgccatgccaaccacctcccttccttggcacatttctccagctgctgcattcaccagccaggatcctttggctgcaagcaatggaagctggctttggtcagccttaccaaaacatggatctgtggacagatgtggggtagctcggagaacacagaagggctaagggaccaggtgacagaaggactagacctgggtcaagtctgagaaatctctttgaggcatacattttggggtgagggcctactcactcttgtttcttgtctcagtcccctcaaggtaaaatttcccaggagggaagtgtgggcttgggccccacgctcactctctggcagagcaccttggtcatccattcctgagatggtgaccaagtgggcatgggatcctcgaggggaacttgaagtccagggcagaagagtggggaatgggcactggccggtctacagcaccagaggcctgccccagcccatgtgcacaagcaacacatcctgggattcttacagcctgggatatgtatggcacttactaggcattattattatcattattattgttattatttgagatgaagtctcactctgtcacccaggctatagtgcagtggctcgatctcggctccctacaacctctgcctcctgggttcaagcaattctcgtgcttcagcctcctaagtagctgggattacaggcatgtgccaccatgtctggctaatttttgtatttttagtggagattgggtttcatcatgttgcccaggctggtctcaaactcctggcctcaagtgatccacccgcctcagtgtcccaaagtgccggcattacaggcgtgagccaccacgcctggcccacctagtaggtttttaagaaacgttgaggctgcctaacttacttgtacctctgacctccaaacttaaggcagaactgcttcctcctcccttccatcccacagcactttgttattatttttaacaactccattattgaactttgtaagaattaacttcaggtttttgtttctttgggttagaattatgtctaatttacttttgtctacatgagttcttgacacagaatggaagcccaatcaacatttgctggataaatgagtgattgaacaggtgttaagtgggaaaaagcccaagtcaaaccaatatatttatctttgaggtatgggggaaaagctcatatatgtttaaaaaatattcaaaacttgaaaataaggtataaagatgattgagacacatagtgtcagggtgtagggcagtctaacaagtccatgtggggggacctgagtccctcatgagatgtgactttgtttgacttcctagttaccattgttagggcccagacattttataattctggaaagttagaggttaagatataggaaacttataaagtagaatgtgtttcttttctgatggcactaaagataatccccaaattataacattattgaccattaagatattgaagtgattgtagccaactcagcaattgaatggcagaatttcttctttttgattgactgcatggaatccttgttcttataccctattttgaatcaactttgccatcctattagttccattattaatgaaacagatttgacaaatgcttaccatccagctcatgagaattatgcttttaacatttgagaatcatactttgatacacacacacatatttggaaaactagacactgtttcttctaaaatggaatggtttttattactttagaattacaagttcatgccaaaaacacctttttctggaataacatctggaatttgtatcgtgacttttctctaccgatcattagctcccttctttgtgtttcttaaccaggcagttggaaatttgaatctgctttttcttcttcttcttcttatgctcctttgccaatttttagcctggaaatgggaagtgatgttactgtggtcaagagctgagctacaatacctgtgccaatacctgtgctgggagaatgactgataatggcattggtcatgatttgtgggtttccagaaccttttgaaaactcttacatgtcagggaaattttttcctgatgtgtctgcacatccccaaaagaaaagccagaagtctacgttcccatctgccttacagctagagagcagacatgtgacatggagtgcactgatcagaggggtacgaactagactctcgttaagaagagaaggttgtgtaaaagacggcagcgtgcagagaccattctgcagagggtactgaagagacatatggggcttgcagaaggtacagagcagtggggaggcagaggtgggtggctgtcacactgtcccctattgtctgtgtcagtgatatgcccagcaccaccagtagctgtgggtctgccttgtttctgttatatagcctccaagcctgattctctggccttgcagagcttctgggagtcactgaatacattcctttttggcttaaactagttagagtagattctgctatttgcaactcatagccaagtctgatccacatcattaataatggaggcatggggacctcagagatgcttgaatcagagacagctgggtagaggcacaggaaggtcaccctcctgaatgtgtcctagaatatctatagtttttcatgagactgagaaaagctttggattgccaccagattactttgcggacaactcttgcaaatgttcaccctactacataaacaatatctcagctggaatttttcttgaagttctatcaagctctttgatgtcctgattctatggtgtctcttaataatgtacacaattgaaagttatctgaagattgatttacatccttttggaaaaataacagtgaaatctccagggtgtaacatacccaccaactgccttgccagcagggataacaaattaaactatacattcaaaaatttgatgatcaggaaattactcctgggatgagctttatgattattgacttcaaagaagtatttgatggtacagtgaaatgaaaatgatatattataatttagtgttttccatgcaaatggaaaagtagcagaaatatctatcatttcagttcaaggaagggcccccctggaaagagaagagatataggcactgtcacatcaggaggtggtttgttatgggtggttgaaaaataggcatgaagtttcttgagacttgttttggctacaagttctacaagttacagagacccctagcccctctccaataggggtttatttttcctcatgttaaataagtctagaggcaggtagtccagggatggaatggtagctccatgataacatctgggacccatgccctttctggatttccatgaccctatctttgttgtgagccctgtcttcatgctctcaaaacggctgccacagttccagccaacatgacagacaatagtaacagacacctgcctgctgagtcagctccttttaaagcgttttcccggaagtcctgcccagtagcttatgttgagtaatcatttgctgggtctgtgtcatgtgaacatttgattcaagagagcctgggaaattttgtttagctgggaatacaatctcttcaattaacatcagggttcagttaataaggaagaaggaagggaaatctggagcctctgatgcacccgagtgtctcttttcatagagtttgctctaagacctggcagtgcttttgacttctccctttcctctttgccagtgcttcctctgtcttctttgttaaaaaaaaaattatcgttcaacctccatcaaagacaaaaagcagcatgatattgtttggctctgtctccacccatatgtcatctgcatttgtaaactccctgtgtcaatggagggaggtgattggatcatggggatggttccccatgccgttctcttgatagtgagggagttctcttgagatctgatgggtttataagacagttttccatgctcttgcttgctgtctctcgcctgccgccttgtgaagaaggtgcctgcttcgctttctgccatgattgtaagtttcctgaggcctccccagccatgcagaactgtgagtcaattaaatctcctttgtgtataaattacccagtcttgtgtagtatctttatagcagtgtgaaaacagactaatacatggcacaatctatttctttcttactgcacttcttcttcctcctattccttaaatgattagatcaaataggatctgtggctgggcacactagctcatgcctgtagtcccagtgctttaggaggctgaagtgggaggatcactggagcccaggagtttgagaccagactggacaacatagcaagaccccatcttgaaaaaagtaaaatgaaataagaattactaaaaaaaattagccaggcctcgtggtgcatgcctatagtcccagctattcaggaggctaatgtaggaggatcccttgaacctgggaggtcaaggttgcagtgagccataatcatccactacactccagtctgggtgacagggcaagacctgtatctaataataataataataattaatattattattatatttaaataaaaaataagtaaataggatctgggttatggagaccccatagtctcctctctaagagagagccgaacaataataaatattgcagaaggatttgaaacttcagagctcccgaaaaaagatgagcctcataaatcaagcaccttcctttttcaaaaattgcatttacatattttctgaaatgtgacttttttacatatgtatttaattatataaataaacatttttagtcacctggattgaaccaaacattctaatgaactatgctaattggctggaatgccaacaaaatcaaaattaatgttaaattttacttttaaaaaaaacctcagggaatcagcttgctcaaggatggaatatgtatattttctttaaagcttcaactttaataaagtaggatcatccaaagagcttctgatccaggagatcaattttagagcccaaagccaaatttaatccacataagatttttaaaaataattttatttgtaaaatgatcctatggtaaaatggacctcttgtgggcatataggcctatagattataacacatgtgttgattggcctctccgccaccaaaatcacgatgcaaaacagctgcattaccctcacaatttcttcatgtggccccttggtaggcaatcttctctccccagctgttggcaaccactaatctgatccctaatccctatagttttcatttcgaaaatgtcattataaatggagtcataagtctgtgacttgttaaacttgattttctttcttttttacaaacattatttattatttattagttttattttctagcttttcttgcttagcataatgtctgtgagattcattcaggtcatggtgtgtatcttagtgtgtttatttttgttgttgaataatagctcataatatagatacaccacagttctgtttgtttttttattcattcactaattgatggaggtttgggctgtttccacttcttggctattatgaataatgctgctgtaacattcatagacacatatttatttggacatatgtttttatttctcttggcttgaaatggcaggatagggggtggtctcctggaaaatatatggggaatattttgttactaaaaataatgtttgtgtgtgtgtgtgtgtgtatgtgggccaaaatcaacacttgtctactacactgagccaagttttttttttaaataaaatgaaattgattttggtgttttatacttgcagtttgccaacctttttacatatcttcacagctcattactttttttgagacagggtcttgctctgtcgcccaggctgtagtgcagtggtgcaatcagggctcactgcagattcaacctcttgggctcaggtaattctcctgcctcagcctcctgagtagttggaactacaggcaggcactaccacgcccagctaatttttgtattattttgtagagatgaggttttgccatgttatccaggctggacttgaactcctgggctcaagtggtcaatccaccttgacctctccaaaatgctgggattacaggtgtgagccaccacacccagcccacatctcatcctttataggaataaaagcagctggagccttttgatttcggtagctgtgggtgcaacatgttgtccagcctcttgttacaacatacttttctcctctcacttcttaatagatttaagatactcacaatggaggtgacaataattattgagctcaggtaatcccaaatagcatcaccacccaagtcccacaggttcactcccacctgtcaccagactacagttgacccttgaacaatgtgggcattaggggcatggatgacccccacacagtcaatctgtgtagaactctgacttcccccagactaaactattaatagcctcctgctgaccagaagcttgactgatgacatgtacaattgattaacacatattttgtatgttatatgtattatatactatattcttacaataaagtaagctggagaaaaaatgttatgaagaaaatcataagaaagagaaaatatatttactattcattaagtggaggtggatcattatgaaggtctccatccttgtcatcttcatgttgagtaggctgaggaacaggaggaagaggtggagctgtttcaggggtggcagaagtggaagaactgtgtataattggagccatgcagttaaaatctgtgttgtttaaggatcaactttatttctgtttctgagttgaatctcctttgacataaccattaaagcgtttttctccaatgtctgcacttttaaattctcctttctttttcatcagattcagtattggagcagcaattcctgatgtgctgaagtcaacagctatctcatctaacaattctgtttcttttgcctggaggaagttgagaactgataatctttgggatgtaggtttagaagaagtcatgagcctctaatgtgtccagatatgggatattgtggtggaagatgttgagcatatcaatcaggatggacaaggttaggttgcagtaacaaataagacccaaatctctagggccaaacacaacaaatgttttaaaacccacttacactttatatccaatgtgggttctttgtggagggctcccttcatcatagtcattccgtgatccagtctgctggaggctgtaccgtctcaatgcatgctcccaagactaccacagcataaaaacagcatagccaatcacactgcagttcttaaatgcttctccttagaactagcacctgttagcagctcagtggaacttcctggttggatgtgccaggcaggtgagtgccctggttccatggagagggcacagaagcttcatgttgtagaccctctgagaccttgtgctgtaagtctcttcatttggctggtcctgatctgtatcctgaatgataaaattgtaatcataaggaaatagcacctgttgctttctctcagatttcaatggctgagagaggtcacatgcctattcatgactttaaggggttagaggagggtatgtgtcctgtgggcctggaagaagtaggaggctagggttatttgtgagttctagcaatgtctaccaagaaggagaatgggatgtggacaggcaagaattgacttcaaaaacaacttgactcatgtcatggttctctctctgactctttgaatctcagcacattattagtttccatgttaatggattgaggttgggctttttttgttttctgcaatgtctctttataatcttatttttgccttacaaaggcattagcatacattttctgggctcccagccagatgaatcattttcttttctgtttccccatctccatagtgccctggtctttgccagaaccaaacagtggtcacagctaggacctgcaccgggggtcctgaatccaccttgcccggtgcccagatgcccctcctgctctctggatggagcccaccctcaacaagcactccggcaggaccaggttccatgaagacaatgccacttggaatctgataagtaatatttggtaccaagcccagatcagcttttcatcaccctagacaagagatgtgtttgggactcttcagtctcccctgaagccctcaggcaggtctctgtcatgctgggtgggattatggtaacactctaccagcagctccccacctgcacctcaggccaggttggagagggtgaaaaagcaacataaaaatgtcaggttcctattggggattaggagacagtcaactctagccaagttttatttttccattctaaaggaagaagaagaaaaaaacacaacctaaattatcccattttccttaacacaccatagatgcgtgaattagaagaaaaaatttgttaaacacccaaacaaaaagaaacaatctggccaccagccaggattactttgcctggagcgttttccatgactctaaggccagcacacaaaagggtttctaagatccatttctggtgagaataaaagctgaatctgaaaaacagatgccccctgaaagtaagaaacagaagaaaatgcaatctgtcaactagccacaatttattctatcaactatcaaaaatttagtctgacatatttgctgggtaaaataaccatgttgactgattgttctcctgaaaaagacagtttgaattcacccaactccagctgagactcaaatagtcattttcaactatttccaaatattaatattttctgcaaagagaaccttttataaaatctcaatttgtaaaactggctagaaacccagttgctctggttgaaactgggggtgggtgctccatgtgatacattaaatatattacaccccctgaaaccctcccctcaatccaggagcctctctctctctctctctcctgctctctctctgtcactcaggccggagtgcagtggagcgatcacagctcactgcaccctcaacctccagggctcaggtgatcctcccacctcagtctcctgagtagctgggaccacaggtacacgccaccatgtctggctaattttttgatttcttgtaaagacagtctcactatgttgcccaggctggtctccaactcctggagttaagcaatcctcccacctcagcttcccaaagtgctaagattgcaggtgtgagccaccacaccggcctgaacaaaattcacatattttaagaatctttgatgtagacgggggacagttctgctaatttaaaaacatctagagttttgcattgtcacaataactcatggtgggtgtcatttctagaatttagtgtaagggttcagggatggtaatgtatgacacacaatcctgtccaaatggccaagtagcccccaggagaaaaaaacaaaataaaactggacagaaggctttagctgtctttacgaggcgggagctaagggtcacccccaatgtggcccgctacagccccagccccctatctctgtcttgcatggtgcttgcttctcttcctctagagcccaaatataccaaatgcttcttgctcagcctcctttgcatccagaagcagccatgggacccaaacctgaccaatgcaacgagagagtcaatattctgaggtgggaagagttcaaggaaaaattttgtttcgtaatgcaacggaggcacaagaagaaactctccttcctgcctttgaaaataattggttgagaacaacatgctggaaccgaagcagcctttctgtgagcatgaggagccatgcttaagaacaagtcaatctgctaaggaaggcagagcagagagacagatatggttgagctgcattcttcatcccctctgttataggggacaatctatatgattcttcaagtctgttaatcaagtctttggttgctgacagccacacgcattttaatagatatacttttctcacttccattcatctggaagcagaaagaacagctctgagggaatcttctttgcagacgctgacacttcgattctcactgtggtttttcttgttgacttagggccacataaatctttccctccttcttggtacttgatcttctgcctctgccgcaggcttgttatctgttttctgtaagtaacgcaggagcttctggttataaacgacttgctaaacttgaattcttaagagtcgtttatctgttagacccaccctaacccaatcaatactcagtgataggaggtgtcatcaatgattgactttaagataaagcagttcttcccctgcccctgctaatttttgtatttttttggtagagacggggttttgccatgttggccaggctggtctcaaactcctgagctcaggtgatctgcccgcctctgcctcccaacgtgctgggattacaggtgtgagccactgcgcccggcttcgaatccattttccaaacacatgtaggtgagtatggaaatagatgaaaggatatgggtcactttacaagataacagcctggaagaggtcattgtgggttacatgcatttgaattcgctgcaatataagctaagaaaacaataaacttttctcacataggagactgggtattacgaagagctgttctttagtccttgcacctttatcactttattttagaaacaaaactcccatcttcaccattttcatttgaaaaatctcccctctatatttcaatctatatgagctgcagtcagaactctagcccaagacccagagctaaaccagtcagcatgtagtttttccagagctaaaccaatcagcatgtagcttttccagaggtaagcccaatcagcatgtagcttttccagagctaagctaatcagcatgcagcttttccagagctaagccaatcagtatgtagcttttctagagctaagctaatcaccacgtggtgtgctctggcaacagcaatttatcaggggtgagtgagcacatgacctaatggtgacccaatcagaatgagtctccggacttccctggaaacttgtggcccttttctgcaggattgaaacttggatgatgaggctgtgccataacttgctactagagctgcagaatgaagctaacacagctgagggtagagtcaaggcatcagggaaactgagtcaagttgaattgagtccagaatctactgtccctgaaaccagtacaatacttagatattttgttattttgttttgggagaaaacaaattcccttcttactgaaacaagtctggtctgcattttctgttgctggctaccgaaggaaggggtcctaactaatatcctggggtagaacagtgcccagttatagaggccccagtttccccattactcatgaagagacagttgctctaaggagcttcagcatctactgccagcatcaccgttctggtgctctggttctgggcgattcttccataacttgtctgagcatgtgaactttggaacagactgcctgagttcaagtctcagcatcaccaccactaactttatcaagccctccatgtctcagttgtcttactgtaaaatggaaatgactttcataaacattaaaattgctgtgaaatgtgaatgtgttaatatgcagacagtgattagcatagtgcctggcacatagcaagcccatcatccatggctgccctcattgttgttatgttcttctttatattgaggatccatccagaacctcccttcattctgctggttgcctccattctcttgtgcctcacttggccagttctccatcttaggagctttgaattcctttcctcagttcaaacgttcctggtttgtgtcccaaccctaataggacttctctttccaaggtcacaggtacctaatctgagatgtcaacccaggtagtaagttagtggtttcatctttagacagggatagtgaaactttgcttctgtgcatctcattcttgtttataaatctctttaaagaatacgaactttgtagtatatttatttttggctacccagaatctattgtaccatctttgggtaactgaattccagtttcccctgggtaaccaccctccaatggctggaccaaccctctgtgtcaggtggactaaaaccatcaggctctttttttccacagctctgactggtccagggatgagtatgtgacacttaagtccaacgagatgcaatgagacttttgttgtggcttctgggagtgccagaggctcttttctaccaggcttagtcagccttgcagccacagcaggagatgctaagaaccgccctgagagggaaaaagaggagcagagggatcaagagacactcatcaggaactgctgacatttgagcctctggatctggctgtgcctgaaactaacaagctactccttccacattctagttatctgatattataaatttatttcatttaaagctatttaacttaggttttgttgttgttgcatgcaaccaagagtgctgactgatacaatcttccaattatatgctgtttttactttaaaaggggtgtttggtgtctcagcctgaaaggagcagtaatggtaggattgagggcacatagcaatccaggaagaaggcaatggtacatagacccctgaaatcataccagatggccagttactactcagtctctagattcagctggttctgcaagaagagttatcaagctatcagctttctcttgcaggcatccttctgtacctttaagacagagcatctaattagctttgggtggtttcagttaggcgtatagtggagaaattaagaaaacattaaaaccaggaccattggaacatgaggatgtgcggcttaagatttacccaagaggggctgacctcaattaggacgttgatgctggattgggtgctctggttttcctctactttaaaaactgttggatccctgatatgccaagaccccagagagatggagaaacgtttacgtgcatggaggaaaaaatatctttttagagttacaaagtgagaatcacagttattctaccactattaagccagaaaatcattgtctaaaatggatatttttttcttttttaatgtgtaaatgagcttcttggttggtttaaaggggcaaagattcccatcagccttcagagctggtcactcatcagtggattggtaaatgcagaatggggttcgagtctgtatcttctttagtggaacagtgggtaatgtcgttttgactcacgaatcagtttccttcactcttctgggctaatgacccacttcctccggcttcccttagctgcacctggtgtttctgtgggaaaggccttcacactgacattcttatttgatagtgaatgttgatggacaccaggcctgcttatgcacaagagcttctgacctgggatcagagaaggaaacggaattttaaagaaatgtctcaagagtcagagaaggcaggagccgagaagtgatcactactgacctcaagctcaaagacctatgggaagtagcaaaattcaacaggatgagtggtgaatccctgggtccttggtcaaaggtcctgaggtcctgaggtcaaatcagaagagaaaatgcaaatttgtccatgtaagaaatttattccaaaaagtcagatacaaaaatttgacttgacaaagcatggtgggttttgtaaaaaaaaataaatggttataaagaggagctgaatgtggaataactttgcatttcacagagttaacatttgaagtttcagctgtttgcaaatgactcatggtgctactcagcgtgggtgaggttgtgctgcagtaacaaataagaccaaatatatcagtggtttaaataagaaggctgcattgccaccacagggtcagctgagacttctgtacattggggcccacctcacagcacctccctcttggcacatccttctacaatcactgtggcaggaggaagataacatggcttcataaagattggcttttaaaatatttgcccaagagcaacactaccattttatcccacatgtcctaggcaaagtcagtcatatggctgcacctgccttccaagattgtgggaaagtgcttggagggacgggggaatatttagtgagcagtagtcatgaccaccatactccatggtatgcagaaatgtggagcagggctggtgggtggacccactccacttggctgctgagcagggctggcccactactcagaatgtgggtgccagggaagcctgggcttctctctcatctgctttgtatatttctcatgatttgattcaaatgcagattctttgtgaaaaattagccctgatgagaaagccagttcctgatcatggaagtaaagggcaaaggaaaaaaattagagggtaaaatacaaaggacaaaaatgacaaggttgtgtaaatgacaagagtactgtaaatattgatactttgcaataaaactgtgcatcgtccttttgagagatgacaacatgctagcagccctcactcgctctccatgcctacttggcctcagcgtccagtctggccacacttaaggaggccttcagcccaccgctgcactgtgggagccccgctctgggctggccaaggccggagttggctccctctgcttgcggggaggtgtggagggagaggcgcaggtgggaaccagggctgtgtggggcgcttgtgggcaagcgtgagttccgggtgggagcgggctcggcaaacccattccagggtgccctgcccttcacaaagaaaactctccctggggctcccatgggcttctctgggatcagtcacgggctccgtgggccctacactaggagtggccagccagagccgcaggccctgggcagtgaagggattagcacccaggccagcagctgtggagggtgcaccgggtcccccagcactgctgcctggcccacgctgctcttgaattcttgctgggcctcagccacctccccgtggggcagggctcgggacttgcagcccgctgtgctcaagagccagccccccggcatgggcttctgaaggaggccacccccggctccacggcgctgggtcccatcaacctagggctgaggagtgcgggcatgccgctgcgggactggtgggcagctctgccctcgtccctggcttgggatccactaggcgaagccagctgggctcctgagtcaggtggggagttggagaacgtttatgtctagctggagtattgtaaatgcaccaatcagcactttgtgtctagctcaaggtttgtaaatgcaccaatcagcactctgtgtctagctcaaggtttgtaaatacaccaatcagcaccctatgtctacctcaaggtttatacatgcaccaatcagtgctctgtgtctagctaatctagtggggacttggagaacttttgtgtctagctaaaggattgtaaacggaccaataagctctctgtaaaatggaccaatcagctctctgtaaaatggaccaatcagctctctgtaaaatgaaccaatcagcaggatgtgggtggggtcagataagggaataaaagcaggctgccagcgccagcagtggcaaccagctggcgttccctttggagctgtggaagctttgttctttcgctctttgcaataaagcttgctgctgctcactctttgggtgggtgtgccttaatgagctgtaacactcatggcgaaggtctgcagctttactcctgaggccagcgagaccacaaacccaccgggagggacgaacaactctggacgcaccacctttatgagctgtgacactcactgcgaaggtctgcagcttcactcatgaggacagtgagaccacgaacccaccagaaggaatgaacagctccagacgcaccaccattagaactgtaacactcatcttaagggtccacggctattcttgaagtcagcaagaccaagaacacacccattctggacacactttcaaatgcatccaatggaagctaaatatcatagttgattaatatgcatgatctttaaaatatattaacaagcttttcttaatagttagaaatgcgtatcatttcctttcctccttctacttcctccggataattttatcttatttcaatttattttgatgctatcaattgctttacttttaaatatactatgtttacaatttaatcagaactgagttatcattggtgttatttgtaacacccaagtgatcaaaacaacacaaacacacagtaaattttgataaataattattaagcatcgaagcaatattttattaaaagtaaagtctttaggagatggatggagggggttgtggagtcttaattaaaggacacttgtcccagaccccactcttaacaagctttccccttgtagaatgtggggtggggggatttgcatgcctaaagcaaagcattctggaaaggctctagataagtgaagatggtacttttttttctaaaagggaaaagggtgattatgaaagggtagatgggaaagaacagcaagagtgttctcagggtgagtactgcagggcatgagaacacactgagtttgcggtccatacccagatacccttgcatggtgtttgtgtgcccctcgggaatgaggtgatctgaattcaaaaaccttttctctgctctctgacttactggcctggcattccatcccctactggcactggaatcactagtattttgtaatgagcactgggtcctctccatagcattgctcacacaccatcgtgtctgtccctgagaatgcgtcaagctgctcagggcaactagtctcgaccaccaccccaccatgttgtagaggcagaggtgtgttttcatttgctcatggacacccatgcactattccttccctaggcctcccttctctccatgactccacctcctcaccaccgcccccttctttccctcctcctttttccttctactcccctccttccattcccctcctccttagccagtcttacttctccttgaaatcattatcacagaatgaaggcttggatgttgtttgcatacaactattacaaagagacccaaagtgacatttctttatgggcctgggttccagcctgtgacaaacagagctgatatcagagaaaacaaattgttaatgttatattggaatttcactgtgggcactagatatttgcaagaggtaaccaaatgtacaaggggtcgaagcagatgaattccattccaaaaccactaagactaaaaagcagctgcaaatgaggtttgaaatggacatccttctccttagagacttcacagtgacaaatggattagtcccaaagtggaacacaaacctgctttgctttcatagaagcgaagaagactaataaaggccgtgtctctatccagccctgaatccaccagggctccgtcaacctctatttaatagcccgatgcttctcagctgagcttcttaattaagtcaccgtgagagctggcccttaagaaactcttaaacacgccgggcgcagtggttcatgcctgtaatcctagcactttggaaggcggaggcgggtggatcacttgaggtccggagtttgaaaccagcctgaccaacatgctgaagccctgtctctactaaaaatacaaaaaaattagccaagtgtgttggcgggcacctgtaatcctagctactcaggaggcggaggtgcgagaattgcttgaacccgggaggtggaggttgcagtgagccgagattgtgccactgcactccatcctgggcgacagagtgagattctgcctcaaaaaaaaaaaaaaaaaaaagtaatcccagcactttgcaaggccgaggtgggtggatcacgaggtcagaagttcaagaccagcctgggcaagatggtgaaaccccgtctctaataaaaatacaaaaaaattagctgggcatggtggcgggtgcctgtaattccagctacttgggaggctgaggcagagaattgcttgaacctgggaggtggaagttgcagtgagccgagatcatgccactgcactccagcctgggcaacagagcaagacttcgtctcaaaaaaaaaaaaaaaaaagaaaagaaaaagaaaaaagaaacccttaaacattgagtcctatttattaattaatgtttagccttccttagtgtaaaaatgtgtttactgagtctattattatttattatattttaattaatagtgtttccaaggcatgacttggaaagagaagctttagtccactcataaccccaggcagtgctctctctatatgctgccatgcagggtactaagaaaaatatacaagcaaagttatgtaataaaatctctaggaaactgttttgctgctgcttataggggacctacattccaattagaaagtgtgacactctgcaaattcagcttcaagaccagtatcctaacctttctcccgatcccatatcagtcaggaaagactgggcaatgctctaataacaaataacccccaaattgcagccaaattgcagaaatcacggcaacatttctttctctttttcacaaaaaagcaattgcgggtccagatgactctcgtgggcagcatcctccatgtggactcagccatccaggtggcctctatcctgcagtgtccacctcacagctctggcaccatcatggtgcaggtaagggagccccagaaacgcttcactctgaagtgaaaccttcatcttcttccatccacaacagttgcctagaacatgccccatgaccccacctaacttcaaggggaggggaggtgatatggtttggatgtgtccccacccaaatctcaccttgaattgtaataatccccaagtgtcaagggcgggccaggtggagagaattaagtcatcggggcagtttccctcacactgttctcatggtagtgaatatgtctcatgagatctgatggttttataaaggggagttcccctgcacaagctttcttgcctgccgccatgtaagatgtgactttgcccctcattcaccttccgccacaattgtgaggcctccccagtcatgtggaactgtgagtccattaaacctctttcctttataaattacccagtctcaggtatgtctttattagcagcgtgagaacagactaatacaggaggtgttctgttcccagaaggaggggaggagcagatatgcatgagtactctatgttcccatcattcctccttccagaacattgccacatctgagaccctcctgtaaaaaattctggagccactaatgctttcgcagtatggaacaaacatattttccagaagaaatcagccagttttttttcctttccttttacataatgcagtgccaatgtcctcttacctggaacagtgcctggcacacagcaagcatcgtaactatttgttgaataattagtgaatacatgactggccgaatgagtgagggccatgcagtgcctctcccattatgtcaggactcttcttggaatgctgactgtgttttgtagagtgcagccctaggaagatgggagacccaggaactggccctgtctctgctgatagctccgtcagcttgaatgaggtctaagccccacggacactctgcataaagaagcatgcatgttgtgtaggtaacggggttggaactgttgtggtcattgcttcatgagggaaactagatagggatagcaccagggatggcaggctggagcctggggagggcggatcacagagaagctctgtgacgtcgtctggggttaggaacccatgaaaagactgaacttcctattaggcagggagaaaatggggagggtctggcttgatgtctcttggagaaatctggattacacaaatatgtgaggccaggaaaccaacaaggaaaacatgacctgtctttgctgataatgattgtcctatctgcataaactcacaaggatggaataagaataaaaccaacaacacacttccgccaagacttgacagtttgcaaagcattttaaaatacaaagccaactctgttaatggtaacttggatagatgttccagcttcagtccaaatatcttacagatatttactttagtcctcatagcatgactatctttatttcacaatgaggaaactgagctaagtattttacccgaggttttacagttagtagccaagacaggattcgaacccaggtatctggctctagaagccacacactgaactctgcatccagcagcctctgcagaaaacacaataaaactcttctgatgatgccagtggctggaattccaccacttatacagaacaatagggctggagttgctctgagagaatcatgtctatttcgaggaagttgaggaaaaatatacctaaattttgttttggtgtagtctaatcctacagtataaagaacttttgtattgcatttgaattcttttatttattctttcatgagcaaaaactttttgcacacttactgtgttccaggttctgttctaagcttgtgcagtgcatgctacctcatgcaacctttgcaacaactctccctgctagggggccactctttcctaaagcaggcaggggcccagaacaggctgttccaggcctcctctatgccttattatcacagagagagcatagaatattcctcaagcaacaagaaagagcaaggaaatacatgttcaatgcagacatccacgtttgtgtcatctcagaggaaggaacaggatcacccgttccctccaagggaaaatatacccttttctttgcttttattggttttaaggcctgggacagtagttctccaccttcttgggtcacattgcctttcactctgccagattctgtttcctttctgtgacacgaggatagaaataacacgcatggcaatggattggggtggtattccaacgaaataatgtaacgatggccctttgtgaagtggaattcatacattcattcactcatgcattcaacacatttactgagggcctattatgtgccaagctcctcttgaagtctctgaggcctgaagagtgaagacagaatagatgctaaaggcagatttctggaacaaactgcctggggtcaaatactagcctcattactcactaactatgggaaagttaagtataaaacctgactcaaagggttagtgtcaagtttaaagaagttaatatctgtaaaacatttaaaatagttcctggcatagagtaagttccagaaatcctttgataataaaaaaatatttttgaaaagaacaactaagaaaaattacattcagtatttctacctaaggagatatggctgtatattttaccttaaaaatatcagagatgttaaaataatagaacaataaatagaataataaacatctgtataactttttaaaaagatttaaagcccacattttgtgtttttttttttttttttttttttttttatggaaacagagtcttgctctgtcacccaggctggagtgcagtggcgccatctcgctccacctcccaggttcatgccattctcctgcctcagcctccagagtagctgggactacaggtgcacgccaccaagcccagtaaagcccacattttctaaatgtgaaataaaattttaattcttaatcattagccatcaagaacacacagatatctagaatgccctaacttattaatgtcttaatgtattagttcaagtctcaaaagcttaaagcaataaaatgtattacctgctgaagtaaaccctcatatacctgtgatagcagttcctccaccatcaagaatctggaaaaaggaggaaagcctagaaaacaacaacaacaacaaaacactgcttcttaaagatatcaaccccaaagtgacacctatcacttcctctttcatgtcactggccacccccaccttcactgagaagaaaaaggttaattcgactacacacctgacttcactgtttgatcatctgattgtggacaagtcacttaatttgactgtatttcagtttccttgtttgttaaatgaaaacagaaacagtgctttgctcatggcattgtcatgagacttaaatcatacacaaaaatgttagctataatgacaatgtgatctacccacagaaaatataaagtattatttgtgtgtgcatgtctgtttaatgtgagtagtatcagactacatttccaatgccgataaaaatgtgtgatctgactgaaacaataacctcgcattttatttcaaacttacacacttacacaatacatccatacatgcgagtcaccattgcgtttcgttcccatgaaaacttggattgcgtcagagttttattgcttttgacccaatgccacttaatgattgaaaaaaaatggtgggttcatgtttggtatttcctgatgcgggcaagggagcagggctgctctcagcaggcggttcttacccacgtgctcactggccctccgcaagctgatgtccaagacgacagacacatggtttagggagctcagatgcttgaactgtgacgcagctggaaacccaatcaggacatcggagaagaaagcagagtgaggtggggtcagaagggggcacgtgggacattcccaggagttggaactgaagaggggtgaaagggagggatgtgggcaaagtcaagctctggaagcagaggctcagggggtaccctgtgtttgtggttggggacagagatggggcaatgaggcccagcacccaaaggccaacagggctaaggtgtgcaatgacttcaggttgactctggaggctgatgagttgtttgtctggatggacgtgtggttggcagatgtcttgtgcctgcccagccttcaccccacacttctggggccatgctctgagcttgctcagggaaccatggctttgctggtctcagcacagctccagaaatgatcatgtggctccggtttgaccaatgaggcgccacatccctctggccacaatgattggctcaggaatggcatgtgacccagtcagacccaatcaaagctcaccctgggccttgctaggggaggaaggatggaaggtgtaagactccaccttcagagccccctgggtgggggtcacatgtgcctcagggtgatgtcaagaaggttgtgctgagatggagagaaaaagagtcatagtccctggatttggatatgctcaaagccagcttgtcattggccttttcttggcatgaggcaatacattcctttccttcgtttaaactagtcggacatgggttttctgtcacttacaacctaatgtcttctaaaacagccttccccaacctttttcacaccagggactggtttcatggaagacaatttttcaacgcatggtgggtggtggggagggattgtttcagaatgaaactgttccccctcctatcatcaggcactagttagattctcataaggaacccacaacctagaccgctcgaacacgcagttcacaacagggtgaatgctcctgtggtaatctaatgcagggatggccagcctttggcttccctgggccatgttggaagaattgtcttgggccacacatagaatacactaacacgaatgatagccgatgagctaaaaaaaaaaaaaaaaaaaaaattgcaaacaaaaatctcataacgttttaagaaagtttacaaatttgtgttggctgcattttattgcggcattattcacaatagcaaagacttggaaccaacccaaatgtccaacaacaatagactggattaagaaaatgtggcacatatacaccatggaatactatgcagccataaaaaatgatgagttcatgtcctctgtagggacatggatgaaattggaaatcatcattctcagtaaactatcgcaagaacaaaaaaccaaacaccgcatattctcactcataggtgggaattgaacaatgagatcacaggaaggggaatatcacactctggggactgtggtggggtggggggacgggggagggatagcattgggagatatacctaatgctagatgactagttagtgggtgcagcgcaccagcatggcacatgtatacatatgtaactaacctgcacaatgtgcacatgtaccctaaaacttaaagtataataaacaacaacaaaaaaatttatgttgggcgcattcaaagccgtcctgggctgcatgctagctccgggccgtgggttgggcaagcttgaatgcctctgctgatctgacaggaggtggagctcaggcagtaatgctccctcacccgccgttcacctcctgctgtgtggcctggcctctaacagaccatggactggtctctgtctgtgcccagggattggggacccttgtcctcaaagacagagtgtgcctctttaaagattgctgttctttccctcgcagtgaaccggtaatacgctcattctgcaaagacattcgaaagatgtttttggcctaactagaatcaattctgttgaattcccccaaatcacatcccaattcacttttttcctaagaaatccaatgttaatttaccctcgaagagcacacaactctgggtgagtctctctggcgtctcataccaatttttttccctttggcaattggtctccagatcattaatgtcacatataacttagggcccaaacagcccacacagcgatctccacagtgcctgtcatgatgtggtcgattttgatggcaaaaataactaattgaaaccctacgatttgtttactttgaatacattaaggtggtggttatcaaatggagctgaattatcccttaaattaccatgaaaacaaaatcaatagtttatttaccacacaaaacaaaagaaaaaagaaggaataaaatgctctgaggaatctttattagaagttttccttggaagaatacaatgtagataaactcagagtaaataaggtatatggtaacttggaggaataaactgacccctagttcataattgtttatttcttggttcctagcttataaatagtccggtggggcctttctaaagtctaaatttctttctaaccaagtgattagaataaatgtcccgtggtccaacaattgagtgcagtgtgggtgtttatactattacttcaactaaatactgttgttttttttttagatggagtctcactctgatgcccaggctggagggcagcggcatcatcttggctcactgcaacctctacctcccgagttcaagcaattctcctgactcagcctcctaagtagctgggattacaggcacacaccaccacacttggctaattttgtatttttagtaaagacagggtttcaccatgttggccaggctggtctcaaactccccacctcagatgatctccctgcctcggcctcccaaagcgctgggattacaggcgtgagccaccgcgtctggccggtacttcaactaaatatttaagattattagtacattgagctcatcaatgcttccactttggggtccaagagcaaaactggagctaattcagattatcaccacctaagttgcttacttttaaaaattattattatttttaaatttggaatgtctcagggtttctgctccaattcataattcctgtgtctttagtggaaatgtcagtactttataggatgacacacacagcattattcctggctgttgagacaccaaaaagcctgatttactgttccttccagaggatccccaacaccgacattgactaaattccttttctgcaagcatcctggcagatgttctggttaagaccttgcaccgtcacgagctcatccttttcatgctccaacagctgttgagtgctgtgtagccaccacccaagcatctgacatgtaagggcccttcctgcccacctcctggtgacagctgacaaactaaatgagaagaaaacctttatttttgcttcaaaagatggaaattggattataaattaatggaaaagcccatctgtgaacatgttcttacaatttctaaatgttacaagtcagagaagcacaagggcctgggaaatactcagtattggtattagtaactcctaagctaggattttcctgggggatggggaggagggctgcaaacagacagggaggctctgtgccctgatctccaagcctcgggggggaaatagaaccagaggatggggctgggctggagagatgggtcaagtcaaggtggagaggatgtgttgagatgctatggcagactgcggtggctcctcgtcgccatctgttttccttcttttttattagatattttatttgccatatggccatatagaatcaaaactccattttccatccaggcttgctggtagatgtggctaagaagttctagttgggggaatataaacctatttgttgtgtccagattctgagaggtatcttaaggagtgagaacattccctctgtccgtctgccagctggaatgcagactcaggcgtctgatctggagccgtcaccttgagctatgagtgagaaaccctttgctgatcatggcagagtaacaagctagaaggagccttgctcctcgatggcatgggggccgctgtattagccttaggctgtcctcctttacataagacagaaggacactttatcttgtttaaggtactgtccatttcggggggaactcataactgaacaaaatctcagatctcatctcagaaggcgtctctgagctagaaatcttggggagattcagaagtgtaataggtagttcctgtgtccaatatgattaggtgtcctggggaaaacttcataaactttgagcaggagggtgtggtgcagactggaagaggtttcagggttttgagaaaggtggtgaagggtgagaactctctcacccaccccaaatacgctgcttcaacttgaggattactgtgaactaaaggtgcttgaaaaacagcagatgcaagaagagcattctgatctcacattttcttcctgaagatgggagataaaaattcccatgggaaagatgccctctttgtgccaggagaaaagaaacattctttgatggggagtcctagccgagataattctgtacagaccttgttaaaacaactcttatcttttcagcctccccacatgagtgagctgctttttcacaacttactgttctctgtccaatttcactatctgagggactgactctgcttctttgggtcttcatttccttaagatggctcccatgccacataaaacttgtactaaataaatttgtatgcttttctcctcttaatctattttaggtcgatttcattctagagcccagctggaaccctaagaggttgaaagtggagttttgtctcctctgcagtggacactcaaagaactagccaggatgggttggacctgggagcagagagaccatggctcccttccaaggctgggagaagggagttgccactccttcccaatcaaaccatgccaagaacgaggcttttgcagggaaatcagtgcagatgagaacttaccaacagttaagatgaataaatatatccaactgcctggcccatgtcaacacgcaacaattatttgctaaaagaaataaaaaaggggccgggcagggtggctcatgcctagaatcacagcactttgagaggctgaggcaggcagatcacttgaggccaggagtttgagaccagcctggccaacatggtgaaaccctgtctctactaaaaatacaaaaattagccgggtgtggtggtgcgcacctgtaatcccagctactctggaggctgagacaggagaactgcttgaactcgggaggcagaggttgcagtgagccaagatgcaccagtgcactccagcctgggtgatagagtgagactccatcaagaaagagagagagagagagaagaaagaaaaagaaagagagagagagaaagaaagaaagagagagagagagagagaaagaaaagaaagaaagaaaagaaagaaagaacgaaagaagaaagaaagaaagaaagaaagaaagaaagaaagaaagaaagaaagaaagaaagaaagaaagaaaagaaagactgactgcatgaacaacagcccaggaaacacaagagaagtagcgtggagtagtggccaaggatgggtgctagaatctcagagcctatatctgtatatcaagatgtctcaggccaatgcctaaaaacagtgttcaataaatatcgaatagtaatattactactgttatcacaattgagaataactgagtgtcaaccagctgatctgcttgccaatgaagggactccaggatccttaagtcacttctatttttctccacttccctggcaactttttctccaagactagatcgattcaacactcctccaagtcctgggttaacctcagtggccctctgcctcccattgtgatcaccttcgtccacagcaatcttttccttctccgacagcacattattaccttgtcattgggcacttgaagtagacatcctttgacatcctctgtgaatgttaccttatttcattccttgttttcccagcatgtaatgggcaaacaaggcccttcaaaaaacagatctgaccctgttgacttctgcagacacatctagcatctctttcaacttgaaaaatcatgtctatattcctgcattcctaagctaccagctaaattttttataagtttaaatttatatttggatgtaattatatatttataaattacatatatattttatatttttaagatatttacttgtgtaaaataaataaataaatgggtaaaattttcagcatattgtaaatactggatattttaagagaaaaccgtaatataacttaaagtatgtccaactgaggctcaatacgattgtgatttgatacctgtcataattgatttttaaaaaaatacatacaggagcttctcatggttaggaacttttcattgttctttattccccttgaacttgtacacccctagaagaatttgatcataatgtatcatagttttattcttggaagttttttttattgattactctatcacatatcactgactgcaacaaaaatatgctcatacatttacatttaaatttaaaaaatgtctctgactataagtctttacattttaaaataagtttttttttaaacttatcattatggatgatcattctggttgttcgcagaacacaattgatcaaagcagcataagtatggcagagctcaggataaagaattattaatctgaaaaaagtaaaattatttggctattcttctcttagtatgataggtgggatttttttttccattaatgtattcatgaatattacttgttattttaaggaggcagtttcatcatcaattttattcacaccgttttgtttttattggtgtaagcactgagcattcgttcacataaacaagcagatgggaaaggggggccttctgttggaagccacgcacttgtttggactccttccaggttatgtgccaaaaatcacacaatgatttatcataaaaatatttttgataatctatgagctgacatccctattaggttcctcttcaatttcagtgaaagtgaagaattgaaaacaatttgactgtaaagggatgtggttccagttatacacccagatggggtacccagttgtcagagatgtttgtgttctcaatgctcaggctaatatttcaaaatgtgtctttgcctgatgccctgaaggacttttcccaggaggggaaaacgcctttgtaagacgcaagctgggtgatggcttttgtgtgaggacgtcttccaccatccacccttccccatcctccttctgtcctgggaggctggttgcatggaccacagcaatgggctcccttctctgctgcttccaagttatgttccctgccagtggttggaggtcagggcagggaagaataaagttgggctccatctgtgggatgacccagggtggctgcatctctctcaggaaggtcacagctccttcacattctacacagcctctcctgtctccagattctggaaacctctttcttctctaactctgcacagggccccactaaccctagagagctgcactatcctttgtggctttctttacttcacccacacctttataaacatttcctgtattaaactttcttcgaattacccaatttgagtgtgctttctgttttgtgttagtatcctgactgataaacccattttttaaattatactttaagttctggggtacatgtgcagaacgtgctggtttgttacataggtatacacgtgccatggtggtttactgcacccatcaagccatcatctacatctggtatttctcttaatgctgtccctcccctatcccccacccccacaacaggccccagtgtgtgatgttcccttccctgtctccatgtgttctcattgttcaactcccacttttaatataatgaaagagggcatttgtgaaggaggaattgaaaaataggatacatgtaggtagggggtctggaaattgatgatcttaaaactgtctatgcctgtgaacccttaaaaaattgtcatgtatccccagaggtgtgagtactccaatctgatgatggccgatctgtgagtaagttctttggtggggatttgtgagattttggtgcacccatctcgctagcagtatacactgaacccaatttatagtctttgatcccttactcccttcgcactctttctccctgagtccccaaagtccattgtgtcattcttatgcttttgcattctcgtagcttagctcccacttacgagtgagaacatacaatgtttggttttccattcctgagttacttcacttagaataatagtctgcagtcccatccaggttgctgcaaatgccattaattcattcctttttatggctgagtggtatatatacatacatacacataaatatatgtatacacacacgctatatatatatatgtgtgcgtatatatatatcacagtatatcacagtttctttatccacttattgattgatgggcatttgggttgcttccacatttttgcaattgtgaatagtgctgctgtaaacatgcgtgagcaagtatctttttcgtataatgacatcttttcccctgggtagataccgggtagtgggattgctggatcaaatggtagttctacttttagttctttagggaatctgcgccccgccctccctgccaccattttccatggtggttgcactagtttacattcccactagcagtgtagaattgttcccttttcaccacatccatgccatctatcattttttgattttttgattatgagatgatggctgatctaatgcctgaccaaccaccctgttcccttcactctatagtggtaaggacatggttgggaaccaaacaagcattaaagaaagctggcaaatgccttttcacaaatgccagatgatacaggtgaaagctatacagcatggtgtttgtccagcaccttccatccctgctactacccggccacaccaccactgccctcatctgcaggggaagcaaattcctcccttgagctcatgggtgcagtgggggctgcctccaagaagccaagaccccatgattgcctgcttgagtctagcaccaatcaccattgaacaaaagcccatctggtttatccaccaggttttttttgagcactgagttagaaattccaggcaacccattgagagttctttattgcagcagcgggcaactgatctacgataacatgtaaaaagataagggtccccaggcgatgacagcagctgcagtttaaagttgaatttggagttattaaagcgtgtgctgcatccacctgcaggaggcaagtgacgatctcaaatctcccatccctgagttggccagaacccccaaggtcaattgcccaacatacttggtgcctctgagacttgaagttcctggcagatggctgtggggtgcgcctgcactagctgtcactgtgactcatccctcagggcatgtcagattctggcatttattttcatttattaattaattttaaacaatagcaatctcagagcctcttagattgtgacccatcacaacattaaagctggtcgagccactctctagggccagggtttttgtgacagtttagattatcattaagcaaatattcactctctccccttcacactgcaggtggagaacacttcccaccctgctgatgtttggctgtgtgacttgctttgaccatttggaagtcagcagaagtgatgagagcaaagggattaaatgtgcagcttggctcactcttgctcctggggatctgctgtgatgagcgtgtgctctctttataacaggagctactgtcccttgatactcggtccagtgcgcacacgtgtggagcagatctgagcccaatccacagcctgcaccctatccagcagagcccatgtcgcagagcccgggtcgcagagccatgagtcacctgtgaatctgcgcgtgtgagaattagtgcttattttgaaccacggagatgggttggcaacaactgacaaatcactgagttttcaaattctgctctgtggaactcaacggaagtcattttcaaaaaaatggtttcattcattcacatatttattaattcacttgcttattctacaaacactttattgatcaccctaggtatcgtgcactgttctagagagactcatccatctcagcttatctgggctgctttttgatcttcctgagagaatggagggcctgtgtgtgcacattggtaaagtgctttgaaaggaatgaatccagcagatttcacagccccttctcctctgcaaggctgtgtagccttctctgaggctagctggggttggtgtgggcgggaaggagtcttgctgctacccgaacagactcagatgctcccctgcctccatctctgcattaaatcaggggctgtcaaggaggaggcaggcacaaggcgatgttcgtcagctcccggaggggcaggtctcttcacatcttgcctgggttcattggctcagccacatgctggtcgaccttgtttctgttttcagataaagaaaatgaggctctttttctttcatcactttgtccagtgaacttaggagcaaccaaccaacttcattatattccttggttctccacgtagggtcaaagatatcaggtatagagtcattaagctcctgcctctcatgagcagtgaatcaggagtatcaaatgcatttattttgcaagaactatcggtgttctccatgctattagaagtagagcccttagcatttttgagtctaatcatattaagcagccaactccagaaacccccaaatcaacaaaagaactccatccttaatactctgttcctctagaattactcctgctaccaaaatctgtatgagtcagggttctctagagggacagaactaataggatagatgtatatataaaggggagtttattaaggagtgttgattcacacgataacaaggtgagatcccacagtaggccatctgcaagctgaggagccaggaagccagtccgagtcccaaaacctcaaaagttgggaagccaacagtgcagccttcagtctgtggtcgaagatgcaagagtcccaaagctgaagaatttggagtctgatgttcaagggcaggaagcatacagcccaggagaaaaatggggccagaaggctcagccagtctagtccttccacgttcctctgcctggttttattctagccgagctggcagctgattcaatggtgcccacccagactgagggtggatctgcctctcctagtttactaactcaaatgttaatctcctttggcaacaccttcacagacgcactcaggaacaatactttgcatccttcaatccaatcaagttgacacttaaccttaaccatcatagaggataacaacaattcacccaattcttggcccagggaaagagcaggagccgcactcacatctctcaaatctcagtcccatgtccttctctttgctccaaatgccacttccctggaggattgtttttaagcccccattcctagtctctgaaaacagggggctttggctcagacaccgtggcctcatcctttcttcagactatgtttgctgagcttccgttatgtagcaagtgctgggaatacagcagtgaaaaaatgaatttcctgttcttgaggatgtgtggaagaacagagatcaggaatgacacacaatctatctggtgaccatgagctctgtgggggaaagctaagtagagtagctggggggttcctttgttaaaggtgtttggggaaggccactctgaggatgtgacagccaaacacagacccgaaggaaaggagggagcaagccaagcttataagagagtaaaaggtgctccaggcaaaaggcatagctgcacaaagaccccgaggcaagaccatgcctggcctgttgaggaacacagtgtttacttactggagtcacccaggagagcagcatgctctgtgttcattctgcgccttgttgccgtctcaggactaaactgcttgcatgaagtccaaggtctgttaattaaaaatgtaacaagggacaccccagtgtcttcagagtaaatctttacaactgagagtttgtagctgaaggcaactaaagcggttcaaagcgaagggcgatttgacaacgacatggctagattcaccagcagggctgggcaggaccacctgctggggctccaggaccacagacatgacattcccagggtgggacaagagaacagctggggaggctgtcaccccatcagggcgcctccctccccccaacagtcaaacataaaaaatagattttttatgactcctcccaccactctgtgctatggacacgaaagaactttgaccactgcgaccctcaacccctggcctttgtcctgaaataaacaaatgagtcctcccatctattacccaccccatgtgatgaagtgggctcctaggaacatcctgcatccaagtggcaaccacagtgcttgtttcaattacctcttatttatcccactggttagggagggatgtcccatcctaaagcatatgagatggctgaacacacgatgcccaacactggacagatgaccttggcagcagctcatcagtcacgtctactaacaccctgggggaggagggcatcacacgccgtgcagggccatgcagggttgtgctggggggcagagaaaaccagccaaggctgtggatggcaggctttgtggcaacaagaggttgaggtgcccctggtccctgcaggaggatgcagttggcttgtttcaataatctgtgggttggcagagaggtgcatccatgaggttgaggaccagatgtggtacagctggtgtagccggtaggggaactggccaggtagagactctttccttttgggtgggtgacatatctggtgagggcaggagaactcatggttaggcttttgggtttctgtgaggctcaaagatgtcaaggcagcatgtgacatttgagacatctcgctgtgcctaaactgtttacacaaaacagcatggtccctggcgaacatgtttttcttctgggagtctggaattttggtacatgccaggccaaggctgccccataaccagccctgaataaaaatcccaggcaccaagtctctaatcatcttccctggtagatgacacttcccaggcattgccacacctcactgctgggggaatttagcacatcttgtgtgacttcaatggcagagacccttggaagcttgggcctgacttctcccagacttcacccatgcaccatttttctttgttgattttgcttttttctgcaatacatcatagtcaagaggatgacaacatgctgagggttgtgaatcctcacagtcagtccttagtcctgtgagtggtcttgggtaccatacaccttgccttttctggattctaagcctttgctttggacctaacacctcatctcatctaacacctgacaccagccctgacttttaggatgatcttactgatcctcagtactctgttcaaatctcaccttgaccaagaattctgaagagtttttaccctccttagaattctatagcctttgatatcaaaatcacctatcgggcatggtgttataaatgatcgtcatcttccttcctaagaaccatccacgttttgagttctgtgacaagtgtcgatttatggcagcccctagcctggaagccaagataagatgacataaaataaacgtttttacattagtttgctctgtcctcaatgctctgtattcactgaaaaaagacttttgaagatagaatcttaatagatatcaaattattatctaatttcaaaatattttgacaattcttcatagacacagctatagcaaagtatgtctgtcagtgatagtgcctacaactggaattagtcctagaactgtgaatcctatttttaagtgtgattagaattttattctttagagcctggttgttttaagtcattaattcagtcatcaaaaattgatggagtgcctactaagtgccacacacagaacattctggaatttcaaaattaacaagatttattatctgctttggaaagatttggtagctatatctggtagttttggcagtttttctgtgtttatgtgcctacccagtatctaatcacccatgtcccttccttgtaatactctctgtggatatcatctgtcttccaggtagcccatgactcagaggggaactgacctgacccccaactacagcagtacacccggattggtctaagctaactagagtaatcctactttaatgaaccaatgattcattcagtgaaaccaggcttaatccaattaatatataatactctcccacaaggtggcccaatcagtgaaaaactcatattttctttggaaatctccttctgaatgtgaaaggcacggttatctggataccagaactgctgggtcattttggaaggccaggctgaggatgaggagaagggcccaatacagagtataaaagataaattggagagggaacttgatcaagccgctcctgatatccaaatttctgaacttattgtttatctgaaccaatagattatttaaaataattaagccaggatgagttaatatttttgatgttgacattcaaaattaatctacattatttactccataacatccatctattctttctctcattgtttattgtctgattttcttttggaaaatgtaaccttcctatattctcagacatgtgttttgagtgggactcctaccacactcagctctatatgacagtttagattagcttaaaccaattagcatattctattattttggctttgatgattggtttagggataaacacaaaacccaattaaggctatagaaatggtaaaaatttcaagacttatgcagtagatacagtaagagacccttctccttcccctagtttctgtggtgtgaggatctgcattctagacatccaggagccattttattgccacagatgagaactcagaattgttcaaagttgaagtccacagatgaagccaatgttgcagaaaacagatgaaggagagaaattaaaacatgtacaatgctggattcgacttgtcatgaagcctgctacctctggacttctctgttatgagtgcaaagaaaaaaatgtttaaacaagtttgagttagattttctgacttttgctacatactaatgttaagtactattataagggtttattctaagtctcatcctaagcttagtcctgggatagactcaggatgaatgaaaccagggaggtgaactggagaagctcacatcccagaggtagaggtggcaaacatacgtggggttgtgacgcagggataattgtaataaacatattaaataaacgaatgaatcattattctataaaactggctgggtgcattggctcatgcttgtaatttcagcactttggaaggccaaggtgggaagaccacttgaggccaggagtttgagattagcctggccaatatagtgagactctgtctctacaaaataatagaaaaacttacctgagccttgtggtgcacgctggtagtcccagctacttgggaggttgaggcaagaggattgcatgagcccaggagtttcagattgcaatgagctgtgattgtgtcactgctttccagcctgtgcaacagatgagaccccaactcaaaaaaaattttttttaatcaaaaactgatatttacagattctggttgaggtaagatgttatatatacactctaccatgtttctcccactgaatgaagatctagaacctggaaagacagcagtaatccgagggctctgaaaagtaaatagttgtaggtggatcacagaagatcagaatgtgaagtgtcactaaactggttgtattggtccattgtcacactgctgtaaagaaatacctgagactgagtaatttatcaatgaaagaattggctcatggttctgcaggctgtacaggaagcatggtagcatctgcttctggggaggcctcagggagcttttgctcatggaggaaggtgagggggaagtgggcacatcttacatggcaggagcaggaggaagagagagagggggaaggtgctgcacacttttaaacaaccagatctcatgagaactcacgaacttattatcacgagaacagcatcgagatgatggtgctaaaccattcatgaaggaccaccagcatgatccaatcctcccattgggccccacctccaacactggggattacaattcaacatgagatggtggggacacagaaccaaaccatatgcactggtggtgaatttgccatgttttgccctttggtatcaccggacctgatcctgaaactcagaagtgagcaatggggcaaagacagagctccaggggcatttcagggatgccctctagttctggttcagggaacttttaacactcagggtgtggacatctccactgtttttttcttttctccattccctcatgcccaagtgagaggtgaagccagttggacttcctctgtggagtggggacttggagaacttttctgtctagctagaggattgtaaacgcaccaatcagcgctctgtgtctagctagaggattgtaaacgcaccaatcagcactctgtaaaatggatcaatcagcaggacatgggcggggacaaataagggaataaaagctggccaccccagccagcagcggcaacccgctggggtccccttccacattgtggaagctttgttgttttgctcttcacaataaatcttgctgctggtcactcttgggtccgggccacctttaagagctgtaacactcaccgcgaaggtccgcggcttcattcttgaagtcagtgagaccatgaacccactggaaggaaccaactccagacacaagctcttaagcaaccttatgatattgatgggcaatatttgaacaagactcagagtctcataacataatatataaaatgtccaggataaaatccaaaattccttgcttattaagaaccaggaaaatctcagtattcatgggaaaagaccacgaagagaccccaataatgaaataacacaaatatagagattttctgacaaggactttaaagcagctattataaaaatcctccaataagcaattatgaacactaatggagcaaatggaaacatagatcctaagcaaacaggaagaatctttgggatctgcagttaggaaaatggcttttagatgtgataccaaaagcacaatccattaaaaaattgatagaattaatatatttgtcataaaaattaagaacttttgttctgtgcaagactctgttaatagaataaaaggtcaagtttgttactgggagaaaatctttgcaaatcatatatctgacagacaaaaaaattgaatgcagaatatgtaaagaattcccaaaattcagcaataggaaaacaaacagcccaattaaagaagaggcaaagatgtgaatagactcttcatcaaagaagatatatagatggcagacacacacatgataaaatattctatctcattaatcactagggaaatgcaaattagagccacaatgagataccactccatacctattagaattagaatgggtgcaataaaaatcctgacaccaccaggtgttagagaagttacggagcaactggaactcgtgtgttgctttggaaaatacaaaatggtacagtcactgtaaaaatcagctttgtgtctccacatgaagttaagcatacatttaccagttgatccagtaaccccactgctgggtatttaccccagagaaaggaaaacttacgtccacacaaaaacttgtgcacatatgtttatagccgctctctgtgtaattgctgaaacatggagggaacccaaatggcctttatcaggtgctggggtaaaaacagctggtgcgagaccactgtgaaaggaaaatcaatctggggaccccgaaatcactaagccacggtgaaaagtcaagctgggacctgcattgggcaaacttgcctcccattttgttcctaaatactgtagcaggatgagctgcagacgaaaatcctcagatactgagttaaagaaggaaggggtttatttggctgggagcatcagcaagactcctgtctcaagagctgagctccctgagtgagcaattcctgtcccttttaagggctcacaactctaaggggctccacgtgagagggtcgtgatcgattgagcaagcagggggtacgtgactgggggctgcatgcactggtaatcagaacgaaacagaacaggatgggaggttttacaatgtccttctatacaatgtctggaatctatagataacatcggttgctaggtcaagggtggaatttactaccaggcttaagtcaggcaggcccaggcctagtttcgggtctggttctttggttttgggtctggctcttaggagctgggctacctgccttttgtttcgcttttctttccttttctgagtataaaacaatataaaacaatatgagagggtctgtctctcttctctcaatacgattgctacaaagattaaaaaaaaaaaaaagttgcccacctccctcacaatttacccacaaggaaattccttgtggacaaaggacagacagaactcagtcatccctctgctcactaagataaatgcatatctgattgtttcctctgccctgttgtttcactaagccagactaaggcataagtgactattcctctaccctcctctcacgcgtgaactgcattttcagtaaaaggctaatcagagactcaagagaatgcaaccgattgtctcttatctacctatgacctggaagccccctccccgcttcgagttgtcccacctttccggacagaaccaatgtatatcttacatatattaattgatgtctcatgtctccctaaaatttataaaaccaagctatgccccgacaaccttgggcatgtgtcatcaggacctcctgaggctatgtcatgggcacgtccttaaccttgacaaaataaactttctaaattgattgagatctgtttcagatactttttgagtcatgccactcagcaatacaaagcaatgaactattgataaacacagcaactcctttgattctcaaaggcattatgttgaatgaaagaaaacagtctcaatattacatactgtacatttccatttatatgactttctcaaggagaaagaaaccatacaatacaagaagggtgtgagattatatggggaaggggatggggtgacttggagaagctagcataaggcgttttttttgttttgtttttctctggggaggatagagctgttctgtatcctgatcatggtggtggttacacaaacctatacacacattaaaattcatagaactgcacaccacacaaaggtcagttttattgtataataattttttaaataacatttaaggtcacactcacacaaaactgatctctctgaaagtattagttggatttccctttatttatttatttttttaaaggacaaccccgctggccccaatctcacctaggcatggcctggatttctgcagaaggacaggccagcagacctcacttcaaaggtggcatcaaacactgttcctgcctataaaaatacagtacaagcaagcctgattttaaagcctcatttttcttcctcttcctcctcctagttctgacagggcatatggaaataatgttagaatgtaaactttgagcatgaatgagaattctatttccagagatgtttatattttttttctcttgggttgaaaccctcaatcatatccaaataaattatttggggatgttggtaagaggataaatcttagggggttttcacaaaggtctgaattctgagaacctctttttcttgggactgtgtgttttctagagagtgggaggcgctggtgggttacatgacattttgaattactatattttcttttccctttatatattcacaaagcactctagatattgggcaactgcaagtccaaggtgagaaggaagataggcttttgcaaagacaatcactgttcaaagcacacgcaaagattcaatgtattcatagagccctcccaaaggaaacagcaacagaccagagtctttattcacattttctcaaccagcaatcgggaaagaaatacaggtaataagatacgaaatacctgttgcctatgtttaactttgtttttaggtagccagggactctgtttaaatggctggtgagtgagggtggaaatattacataatgaagagaggggtgtttaaggaactgcagtttaaagttttgtgcaagaataatgccatgttgttttattttgaggtggagtctggctctattgcctaggctggagtgtagtggcgcgatctcagttcactgcaacctccacttcctgggttcaagagattctcctgcctcagcctcccaagtagctgagactacaggtgcacgccactacacacagctaatttttgtatttttagtagagacaggatttcactgtgttggccaggctggtctcgaactcctgacctcaagttatctgcccgccttggcttcccaaagtgctgagattacaggcttgagccaccatgcctggccacaagaatgatgtgtgtgtgtgtgtgttttttttctattccaagcacctttcctgcctgcccagttttgagagcatgtgtgtgtattcattagtaagcttcggctgtaagtagcaggaatctaaattaaactgcattcaaagataagagaagatggaagtggaggattggtttatttaactaaaaagtccggaagacgattgcaggcatgtttgcatctgggggttttatccattatgagtcttagttacaagcaggaaaaatcaatctaactcattaagtataaaatgccttattgaacactaatttttcatgtagaaaggcatgaaattataagatggaaaattttctaaacatgagaggagatttaaatgggggcaaacaataataaagacaatattaacaacaatggcgaacacaattccgtagttattaaatgcctggcagtcttctaagatcttgtgtccattaatttaatcctcaccacatccctttggagattggtcttctttggatgaagaatatgtgataaagggacctaaagtaacctacccaggtctaggctgaccatccctcctgtcttccctgggacaatcccaacataatgctgtccaaaaataatgaggaacacccccatttattctcaaaagtggtctgatttagtcaatagatttgatcatcattctactagggtcctacagccaggaagagaagtttggatggcaaggacacacttgtgaggtccgatgacattactagattgtctccctcctccatctctcagccctgccttcctgtttgggctcaccttcaggtggtcctactccacaggggggaccttgtggcccgaggctgcccaggctgagctcctttcacttccaaagtcaattaaaagagacatcccctggctaagagtttcaatagaaatcagaatttcagctcactggcccagggtgggtctacgactcccttttggaacctcggctgatgccccaggaaactcaaatgctgagagtagtgggtattgctcaacaaaaaaggggttggagggtgttctgatccagagaagtagaatggatgctgggattgggggtgccgtgatccagaggaatagaagggacaagtggcagatgtccaacctaagtctcaaggccaaccatttattatggctcctttgtacaaaagacttgttggcaaaactggattctttctgcactctctgaaatactatgtatttactgatgatcacagaaggctgatcgtatcatgatacaatcagatgttgccattggaaccaattctgtcggtgacacaaagatgggcagaaaaaagggtcctccccaaatagtttgtaatctagggcaggggttggcaagctttttctataaagggccggatagtgaatattttaattgtttttttttttttttttgacagaatctcactctgtcgcccaggctggagtgcaatggcatgatcctggctcactgcaagctctgcctcccaggttctcgccattcttctgcctcagcctcccgagtagctgggactacaggcacctgccaccacacccggctaatttttttgtatttttattacagacagggtttcactgtgttagccagggtggtctcaatctcctgacctcatgatctgtccacctcggcctcccaaagtgctgggattacaggcgtgagccactgcacccggacaatattttaggttttgagggccacgtgttgtctctgccatatattcttgtgtgtgtgtgtgtgttgtaaaaaccattgttagttcaggggcaggacaaaaacgggctgagtgggctggatttagcctgaggagatggttggccaattcctgatctagcagagatgacaagaagacatagttgtgtgaacagaggccatggctgccttatgtcgcctgtggtggccccatctgtgtgaacctgctgggtccacatgaaggaagagaggagcctcaagaagggccatggaggtgagaccccagagtggacaccagggctgctggagcagagccctgcaatttgctggcagtaatggatgtttctcctgagaaccccttctgcccactgttcagctcagacccaccagggtctcacgtcctgagtggagccagaaatgaccatgtagctggtaagagccagggtactcgctgctgccagagggccctttaggtgtagaggagagtttctcacttgctcttctcctccattggctactcactcaacacctagaataaacaccagactcctacagagtctgcgatgtaggtcgacctcctgcccaattctccaccctcctggcaccctcccctttggcctcctaccccagccacacccacctccaggcttatgagccaagcatggtctctcctctatggcttcacaggtgctggtcccctgcctgaaatgttcttctcgtcagcatccacagggctcatctcacgtaggtctcttctgaaaatcgaccttgttgagaggcctttccagatcactctaaaatagccacctctgccttctttatctttgccttgcattaattttctttgctgcacatcacatatgatatgctttggctccgtgtcaccactcaaatctcatcttgaattgtaatccccataatccccacgtgtcatggaaagaatcaggcgggaggtgattggatcatgggggcggtttccttcatgctgttcttgtgatagtcagttcccatgagagctgatggttttataaggggcttttcccccttcactcctcgtgctcacactgtctcctgccgccttgtgaagaaggtgtctgcttccccttcccccataattgtgagtttcctgaggcttcctcagccagactgaactgtgagtcaattaagcctcttttctttataaattacccagcctcgggcagttctttatagcagtgtgaaaacagacaaatattagattggtgcaaaagtaattgtggtttttgccattaaaagcaatggcaaaacagcagttacttttcaccaaccaaatacaacatctttgatatatttgtttgtcaattcatttattgttagtccccccaactgaaccaaaagctccaggagggcagggatttttgtctgttttgcctcctgtatgcccagcacctagaaaaattctggaacaaagcagcactccctagatatctgctgaatcaacgaatcaataaatgaatgctggcacaaagataatcactcttttccagaggccttgaacctaagaagagatgaaaaatgctacagccacaaaaggaaagtctgtctgagctaagacagagatgccagattctgatggcatcaattgaacaacttgatcaagctacacctgaagctagccctactgctgcagctttcaatgacaaaagtcagcaattctcttcataggtttctaaatcattttgggttggagattttgcttcttgtaataaaggatatttttatttgggtagtcaggagagaagaggacaaggcggaaaggcaaggagggatgaagatggagcatgtgagtggtcaaatgatacatcaggagatatggcaattctggcctctaagaaaatatagttctctgtaagccttagagaaaatccctttacaaacacagcaaagcctcgagctgggcttacttggaacacacattctcactacacggagagtccagcacaaagcaggaaggagcgtgggccacagagagaacacagaccctggggtcatgtgagtccagtgaggctccaacccgcccaggccgctttcctgcagtgcagcctttggcaagccctcgaacctcaagtttctcatctgaaaaatgggctgataaatctgaatcccagcagtgttataatgagggtcagtgggacatgtatattagagcacctcgtgcctgacataggacctggcccatggcacatgttcaatacacagcagctgcaattattctggtggggtctggatttcccagcttcaagtgggtacctgaatttggagatttgctaaaactctgcctcctaccatcagaatttagtgtcagaaatacaattgggccaggtgtggtggctcatgcctgtaatccaggcattttgggaagctgaggcgggaggattgcttgagtccaggagttcaggaccagcctgggtaacatggagaaaccccatctctacaaaaaatacaaaaaagtagctgggtgtggtggtgcaagcctgtggttccagctacttggtctggaggtgggaggatggcttaaacctgggcggtctaaactgccccattgaaacttctctgttttcttacatctgttttcttctctgttttcttacatgcagtgagacgagatcatgcctctgtactccagcctgggtgacagagcaagaccctgtctcaaaaagaaaagaaaataaacagaattgttccactgacaagccagagaacatcacttccccagagattgtgtcccaccaaattacaaaatgcttttgcaaccaccagcacagaacatcccatagaaagcattaaatgacagtgggccagccagatgcggtggtacacacctgtattcccagcactttgggagcctgaggagggaggatcacaaggtcaggagtttgagaccagcctggccagtgtgatgaaaccctatctctattaaaaatacaaaaattagccaggcatggtggcatgtgcctgtagtcccagctactcaggaggctgaggcagaagaatcgcttgaacctcggaggcggaggttgtagtgagccaagatcgcaccattttactccagcactctgtctcaaaaaaaaaaaaaaaaaaaatgacagtggaccatatactgatgaagctcccatctttcttgtttccttctcggcttcctttccatccttttggttaagccaatgagagatgctcagtagggtgcaaacaatgtcttatcatcctaggaaacaatggcttcctaatcttccatgctaattagggatgatgtctgaacaggaattccagttactcaactgcacagccatgcatctttcaatacttggtgcaccttcgcttaccagtttagttaagctctaaggagatagcatctgtctttttgacaagatgtaagaaaacagagaagtttcaatggggcagaaggcaggaaactttcataccaaggatgggcagcccaggaggagggacaaaggccggggcccctggaaattgggaattgggggtggggggacaggtggggagcaaggttgttagaaggaggctgggaggtggccatggagagaagtatgatggggacatgctgaagccacagtccctcactgacatcctcacagagggatgcatttttctgctgtgctcggaccgttgtggatgcttctgttccagtagaaaggtgcactgtgaggctcatgcctgccctgtcccaggcccagagtcgtctgtcatctgaacacctccaagtcatctgcggctggcagagtcccagctcccatcaccatccatcaaagctggtgatgaatccaatatccggggcctgtgagcccggagagaagcgaacagaacccatctgtgtgggctgcttggcgctgggacacaggggcctgaggagctcctgatggaggaggaggccagggctggcagcctcacatgttttccctcccgtctcgaatttctctgtccaggagtagcagacagtgtggaatgcacccctccagagaaaggggaaacctggcagcctctgaggcccgtccactcactggacacatggaaatgagccccaaagggaagcttggagaagaaggagccatttatcaggtccccattcacctcttcctaaggacacaagaagacttgtttggccactgctgagagacccactccactggaagaagtttccagaagttgatggatggtcgcctgtatttcagccagttgttcatgactcagggtcaatgctccattgctcccattcacacgttgcatccatcttccttgcagatatttgagttctcttctgtttccagcctcaacatatctcttgcttcctatccatatcaatgattcctaatacgtgtgtcagacaaaggctgttactgtaaaatggcagctttcttcatagaggttccatctgggctttgacatacagtggttccatggaagggttaacaatgaacatttggtgttttgaaaatgtgttctgatatttcagaagaaaagctgaagcaggggcggaaatcccccaccaggaccctggaggcatggtggccctggctctgagatgcaccagctactgaaattcacataataaaggaaaaatccaggaaaaggtggggagagaaggtggcagaggggatggaggaagagcagagggagagtgtggacatcctggaagagaggggaggagatgcagggaggagctgactgaggccccatcctctgctggaggtttacagacatcactttatttcgttctcgtgacaagctctccaaggcaagaattatgttataaatagattaaggttggcagctcttttttgtttggttgttttttgtttggttggttgttttttgtttgtttgttttgtcttgtcattgttgtagcgtagcacatagagcaatacctgacacatcataggcgctcgagaaatactgatggatgaataaactaaagaatgaataaaatgaataaagaaggctctaagatatgaatagacatttctccagtgaagatgtgccaatggccataaaatacaagaaaagatgctcaacatcactaaccattagagaaaagcaaatcaaaactacagtgagataccacctcacaaccattaggattcctataataaataaaaaaaaaaggaagaaacaagaaaacagaaaataataagtgttggtgacaatgaggagaagttggaacccggtgccctgttggtgaggatgtaaaaaggtgcagctgcaatggacaacactatagcagatcctctaaacattaaaaatggaattaccatacgatccaggaattccacttctgggtatgtacccaaaattactgaaagcagggacctgaagagagatttgtacacctatgttcaaaacagtattatttacaatatacaaaaggtataagtaacacaagagtctattgaaagatgaaccaggtagacagcgcccttgacataagtgactccatgttaggaaaagacttcatcttatacttcaaatagtgtcatgtcaacagggaccagatatttgcctaataaatagagacagcccccaatcagataagaacataaccggacatgcccttttactatcatcaccaggggaccctggagctataaaaagagcagggcttcgccagcttaagatagccatcttaataggcactgccttcctgtcccttgtgatcagcatccaggatctgccactgaaggactgcccaaatcaaagactattctttgcaagatgttgatacccatccagatcaggccaggacactcttcttgtccacgtcactctccttggactggtttgttaaccatttttcctatccccttttctcttgatgtcaaatgttattttgtttgatgtggaatatttaacctatagcatttatatattaagtatactactatgtatggcttgtaatattcactgatttgcggatcgtcttgaatgtgtgtgcccatggctttgatgaccaagtgaacggagggttggggtactaagaagaattgtctccttggaaactccatgtaatttctggcttttatggttgaaataggatcaataaaagtctgaccttgtggaaagatacaaacgtgcattgacctggttatgtctgaccttgtgccactcatgacaaacgaatacagaaaatgtggtatatacgtacaatgaaccattattcagtctcaaaaaaagaggaaattctgacccatgctatgacatggatgagccttgatgacataatgctaaagaaaagaaatcagttatgaaggaacaaatgtagacgctcctcaacttacaatggatttacgtcctggtaaacccatcatacattgaaaatgtcataggccaaaaacgcatttgatacacctaagttgcagaacatcatagcttagcccagcctaccttattcggaacacttacattagcctaattttgggtaaaatcatctaacacaaagtctattttataataaaatgttgactatcttatgtgatttattgaatattgtactgaaagtgaaaaacagaatggttgtatgggaactcgaagtggggttctgctgcatacgtgtcactttcacaccattgtaaagttgaaaaatcctgtgagttgggaccagctgtgctgatgattccacacatacgtagtacctggataggaaaattcatagagacaggaaggagagggtggttgccaggggtggggagaagggagaatggggagttagtgtttaatgagtacggagttgcaattttgcaagatgaaaaggattctgtgcatgagtggtggtggttgcacaacaatgggaatgtgcttaatgccaccaaactgtccacttaaaaattgtggaaatgggctgggtgcggtggctcacacctgtaatcccagcactttgagaggccgaggagggtggatcacgaggtcaagagttcgagaccagcctgaccaacgtggtgaaaccctgtctctactaaaaatacaaaaattagctgggcgtggtggcgtgtgcctgtaatcccagctactcaggaggctgaggcaggagaatcgcttgaacccgggagggggtggttgcagtgagctgagatcgcaccattgcactccagtctgggctacagagcgagactccaccttaaaaaaaaaattgttaaaatggttaatttttaagtgtattgttttaccacaatataaaataatattttattttattaactattattaacacaatagtggtctttggcaactatgggattatttcaggggttggctaaaggggtctcagcttcaaaaagacaaagctgaggaaaagggagaaaagagagtgagaaacacagccagaaggggctgaccagggctgagggaaaggaagctgggccagggctgcgggcgaagccctgttgaaagggcaggtgaggcctcacaggcaggggctcgagacccagccaggttgaacctagggctggcaggacacttccatagtgataggaagcccagcctccctcccagtgcctggcgtgggccgaggccttgtccatcgaggcctgctctgtggattcaggaagaagaccataggcaagaaatcttttcgtttcgggagacagaaacctacctcaaattgctgcaagccaaaaaggaattcattggctcatgtgactgagtcatcaagggataacacaggctttgggcacagctgcattcaggaatctgcctctcattccatccctctgcttttcttccactgttttcgcttaatttgtaggcaggttttcccctcatgatggcagagacggtcacaagaagctccaggctacatcttacagcccagcaatttcagaagtatgaaagagagccctgggaggccgaggcgggcagatgacctgaggtcaggaggtagagaccagcctggccaacatggtgaaatcccatctctactaaaaacacacaaaaaaatgagccaggtgcagtggtgggtgcctgtaaccccagctacttgggaggctgtggcaggagaatcacttgaacctgtgaggtggaggttgcagtgagccaagatcatgccactgcactccaccctgggcaacaagtgaaactgtctccaaaaaaaaaaaagaaaaaggaaaaaaaaaggaagcgagaccagatcctcagagcgctgagtgctggctaacctccctcattggccgggcatggtcatgtgaccatcttccattcaaaactttgcccagcagaatggataactctgattggccaggctgaggtcacatgtccactcctggagccaagggtggggtcagccccacactaactacagggagaagaggtggttctccagagggaagacaactgctgctaccataagctgcagaatgcatgcgaggcagacaaaacctggaaggccatgccagtgctccttccccataagacccactggacaaggcagcaccaggttcctgggctcagacataagaatgaggcagaagccaacagacagtagaaaacctgttctctgtagcttccaaggaatgacgggccacagggcacctttggcctgatccttctgcagacctggcattgcccggagaggctatcctcggacaccctagtgagatgaccgcatgcccacaccctcactgacaagcagcccacttgctgcccgaaggagactgagtggtggcactgtcctctctctctggccaggaggctggcatttggcagagctgccagtactggcagctgagagcttctcagggtccatgccaagtggtgtgacccagtgggactgagtgtgaaacacctggcccagtgcatttctgagccagacaaagccagcctctctgtgcactgggcatgaaaagcaagaccaggcagccacgactgagggacaccagggcatcagcagcttgatggggagaccaattgtactttgaccccatcagcaggagaaactcagatacaatccttaagcacgactagagtgggtgagagcaagagggggcagaggaaagatacaaggaggcagctcaaaccctcccacaacttcaaagtgggaacggattcctcaggaccctctcctgggctcattcactatctcctctttcttctcacaagcacatccattttacagggcccaaggaagaaggtgagggtagatgggttggaaactaggaatgtcttccattattcacttttctcataataatagcactcctgaattctagctgggtgtacagctgcacagagtgaagactacatttcccagccttctcagggctgggtgtggccatgtgaccaggctctggccaatgagactgagcagaagtggtgaatgtgactcccttctggagtcctcaaagggcaaggatggcagctctccctttcatgtggttggaacccagacatgtcagggagctgtcatgggccatgtggaagaggggcacaccctagggacggcaaccacaagacagagggagcccggtgcctgcctgaccccattgtagagtggagctgccctaccacctatgttgaggtcactgttgctttgggtctttgcagcagcagcctaacttatagaccagctcttccagattggaggaagaatccagagaattcccctcaaatacaccagtgcccttcagaagaatgaagtcaaaacacggagacagaatcctgggacctagggtgggaaagaatggagtctaagctctgcccacccattcagcaggtaggcaaggtgagcctgtctgccactgttcctgctctgaggataaggaggtgaaacaacctggtcaacagcattacctcctggtgctgacagttcctgtgtgggaaaacagacaatcaataagttaaaaacaaacaaacaaaaaaagatgatatttttctgagagtggtgagtcctctgaagaaagcaagcaggcccgctggtgggaaaggctagtttatgttgagtggtcagaggagctggcatcagagctaaaatctgcaagtggagaagaagctgcatgggaagactttcacagtgagggaacagcaggggcaaaatcccagaggcaggaacagctttgcacaatctcctaagaaaaatcttatgatcctaagagctacacagcatgcttactgcgcattaggagtggttcttggcattcctatgtgtcatatcctttaaccctcacccctaaggtaggcgtgatgattttcttcttcattttacaaagcatgaaactgagacggagggatgtttaatcaacttgcctaggtcccactgctgataaacaatcgagccaggcttagaactccctcccttccctcccaggctgggaactctctccccttctgcacttccgttttaccaccgagccttaaatcctgcagtggcttgaaaaatataaaccctgtagttgtcagagctaatgaggacaggcctgtcctgtggcctctaccccatccagatccctggctggcttattgaggtgtcataaaacctcactgagtgaatatatggagaacatccttgcctaaaaggacggtcaggggcacagaacaacatttctttccttcttatttctctaatggagcagaccgtcttgaagctgtaactcaagccaatgtggcaatccacaatcagccatcactgagtgccaggggtgggtcagcacttatgccaggatcctggggttaaaaggtgaatagaccacggatctcagccccctcaaagattttggtgcccatcccagccaagctcctatggcttttatttccttgaaaagcagcatctgagcagaacagctaaagaaggccaagtaagaagcagtcttggctgagtgtgatgactcacgcctgtaatcccagcactttgggaggctgaggcgggcagatcacttgagcctaggagttcgtgactgacctgggaaacatggcaaaatcctgactctacaaaaaatacaaaaaattagccaggcatagtggtgcatgctggtggtcccagctacccagaaggctgaggctggaggattgcttgagcccggggagatggaggctgcagtgagctgagattgcaccactgcactcggccactgccttcattcagttccctgtttcttttgctgtcatctgctactgatctctttgtttccagtcttgtcctaaaatcccatttccagagatcctgtctaaaaaaaaaagaagcacacagtcttgttgcaaaggaatcaaagatcaataaaattaatgtcctgtgaataaaaccatgaatgaaagcccctctttgccccagtttccccttcacttccacttccctccctgaaagccaaccttatcaatggtttgtatcctttcctagagtttggttttgcgtaaataggggtacaatgctttagatattgctgatccttttgattccgcttgtgtcccctgatacttttgcctcccaaatatttcctaacgtccacccccttctctgcagccattgccctcattcaggttcctatttctcttgctgtcatctgctgcagatctccctgtctccagccttgtcctaaaatcccaatttcaggatcctgctggagaaatctaattaaaatgcaaataaaaccacgtaagggacatttgagacattctgaagctacccagcatcttctgaatgtccacctggtgttgagatagtctcccattgtgcagtttctacctctccaggaaagaaaccagaagacattcatccagactcccttgctgctgggggcagtcatgtgactttggcttctccaatcatatcctctcatttgaggctatgatttgggagggaatatggaggcagcttagacagacagaactgaggttttcttaaagcgagggagtggaggcatctggttgttctggggtggcaggtgcactttctggtgtctagtgccccgtggtttggtgcaactcctagctgtgtgtttcctgatctatgcgctggccctttggaagagtctctgtgccacctactaccctttaatgaatttctgttttgcgtaagccagagtggattctgttgtttgcaatgaagcagactgattgttacagatcacatcactctcctatacaaactcttcctgtgtaaaagttttcattggttcccctgcctgcctgctcgcccccctagcctctccttctggtgccctcatttcacatttgtactccaaatatacaccaactgtatgctctgcaccgctcctccttttatgctattctgtgtactgaaatttttatcttactactggctgtgatgtgcccacttctcagaagagacagctgagtctcatggacatggtcacatggtgctgcagagccaggatcaggactcagtctcctgcccttccatcaaacacacgatcttgctttggagaaagcgtcaacaccactcaaccactttcaggctgaggccccttctcctttgtgctgaatgaaagatcctgttaaaccccctttccctgatgcccctttgcccacagcacatgcaccacaccatgcctaggctatgctccctctccaggctcaggcaccaccccacacactctcctttgcccagggagcttcctctgcccaaactgtcttccccatctctgtggtctggctttgaagccagactccgtgggttcaaatcctgactctgtctcttctgagattaggcaagtcactaaatctctctatggctcagttgccttgtctataaaattaagatggtgatggtagcccccttaagtgtgttgagtggaataacagaaaaacacggatgagtcacttagaagagtggctggcacttagtgcacacacggtcaacgttagctactattattattattaattgttttttttgagacagagtctcgctctgtcgcccaggctggagtgcagtggtgcgatctcagctcactgcaagctctgcctcccaggttcacgccattttcctgcctcagagtagctactcccagagtagctgggactacaggcacctgccaccacgcccgcctaattttcttttgtatttttagtagagacagggtttcaccgtgttagccaggatggtcttgatctcctgacctcgtgatctgcccgcctcagcctcccaaagtgctgggattataggcgtgagccactgcgtccggccgtcagctaccattattttttatcattatcatcatcatctggcaaagtctacatctgcccacctctcatggcccctgttccctccgggcatcctctctccagtgggaggaggaatcattgctttccacttgcggctcccagggcacctgcacctagtccttacttaaagcacatgccatgcctcttctgagtgctacaggcaggaagcagagtggatgcttaagaggctggactctggaaccagaaggactggtttcattccctggctgtagctgcttatgagctgtgtgaccttgggcaagtgacttaacctctctgtgtgtgcctccgtttcctggggaaaatggagatgataataggagcgatttcatggagtaggtgtggagacccaaccaatctgttcatcctttgtctggcacacgggaagcgatcaatacatgttggctcatcttagttgtttactgcctgtcttgcgctcaacactgtgggtgtcttcagggcacaaaccaggctttatttacctttgtgctcctggcaccccatgcagtgcctggccctgtgagttgccacgtaggtgccctgcacttgtggtctgctctcatgtcagttgtttctttcatgcctcccacctgaagggcactgtttcaggctgaacaagtagaagattgccgcccaccacacttaattctcttttgggctgctggcccaggagctgaagaaggcctagggcctgggggactgttagctgtggggagctggcacttctcgacaggggccttgcggaccacccgctttgatccttgatcgggagcatttaggacctcatttggactcattgcgaaggatgcctcacacagaaggccatggcatatgcgatctctcaggctgtgccagatggtggggctttggcggagctccctctgtatctgcaagcccgctgacccattcagaggctccaaactgcaagagagaaatgataatggtgctttgaaatgactggagctgggagatggcaaggagcctggcaaagaaggaacacaccgttgtcgctggtacttagctgtattcatggaccagcaaagcaagatggattccagccagcttaatgagccccctcggttagctgcctgattcattcaatttgaccaccatgcaaaagatctagaatagaacagtggttaagagatcgggacctggggccctactgcctgggctcagatccaagcttctctgcttaccagttgtgtgaacttttgacaaagaactttaatgctctatgcctcatttccttatctgcaagatgggaatatttttgctataacagtgggaggacatactggatcgacaatgctgtttgcctgtgtatcagtgtgacagaagctaactcttacacagttcttaccacattccaggaactgttcgtcacgtgggcttgctcatttcatccttacaaccaccccgcccaccagggagatgctattattatctctattttttaaaataagcaaagtaaagggagttgaaacaatacattcaaggtcacagtgcttgaaattcaaacttaagcagtctggcttacaattcatgttcttaccgtcatgctgtgctgcctgccaatatgatatagatctaatcaaagacagatagattcttgccctgaagcaagtgtttgtgatttactctgggagattaaaaagaagccgtgtatgcacaaacttaagacaaacacatgctatctgcttagttaactgatgatgatcaatcaagcttttctccctcaaataaatggaattaggatgatcttggctgtaagtaacagttaacccaactcaaagtgtcttcaacaaccatgactttgatgattagtattactcacctaggagttcaggtagctgctggttggttaatccaggggctcaaagacataagtaaagaacttagttctttctcattttgtgttctgcgatctttggggcatcagctccatccacaggccaacacttctgttgacaagatggctgatcacagttccaggcagttccagatgtgagaaatgtatgagagaggagagaggaggggttggtctttcttggttatcctcttagaagcctgaaaatattctctggaatcttccagaagactctgcattgggtctccttggccactatggggtcacatgcaccttcctagaccagtcactggcaggaaggtcagtgagggtgccatgattggtctcatctggtgccaactggatactggggagccaacagccctggccacggcacatgctttgtgcttttctactttcctccacttgcttcagccattcctcctgcagaatgcctggtctattcctacatatcataatggttcactgtctagaatcattttagttgcaagtaacaggaaatccaaccaaaggtggtttaaataaagaaacccagagacaagcagtcctgagccagtgctgtgtcagtcattgatgtatcaggggcctgggactttctgtcttagtgctctttatcctcagtgcactggttttcacccacaggtgcactgctgtctagttctaaaatggctgcttcacctccaggcaggaaagagagagaagggagttggggtaggaaggcattctcaggaaccctcctgcagctttctatttacatcttattagctggaactgggccatgtgaccactgttagctgcaagggaggctgggaaagtgaatgccttagctgggcactttgccacctcgaacaaagccagagtcctttggttagaagaaagaagaggatactgggcaactagcagtgtctgccacacctttctttaaggatcaactcacactgcacaccactgcatccttccctctttatccctagggcataggctgcctgtccccttctgagaaactaaagtgaaaaaggaagagaagaaaagaatctaatgaaatgatttacctatttcagctcgaaaccctgccatggtgctgcagacagagtatcttggtaggtcagggaaattgaggctcagagggcagtactgacttgccaaggtcatggttaactatgagactcagcaggaatgtgaatctgggtttgttccacttgcctgccctctcctctacaccgtgctcccatggaagccccaggtagcctgagtaagtggtcactgaatgctcatggaaagttctcctgttaactgggagggagataactcatctctcccagttataccgtacagtcctcaaggtcagaactgatgcctgtgctcccactacaaggtcgagaagcctgtcaagggcccatcacaattgcctcctagcagaggacaggccaggccattgtggactgtagttgacatgagcacaatttgcagattctttttgactctaaaaacccaagaacattgcttctgactgtggcgagaacattaagctttcaaataggcaccgcgctacgacagaagctaatgcaagccttgatcatttttctctttcctttccctcctctgagttctgctgggagccggttcgagggaagttggctaattggaactgtccacactgcccccatgagaaatgggatgttgtacaccatgttccctggagaaaatctcccatctgttcaccgcatgagaataattacatgtataaattaccgccttctcatccctctccggcttgtgttggagagggggtgtgcttatgatggaggttcctgagtgacctttttgatgagggaatgtgacgaagtcagctcctaaatcagccatctgcctgagcacgactgtggtattgattttctattctagggctggaaaacggacatttattttgaaatatgtttagtaatgaatctgtgatttgcgaagggtgcttctgcaacgattcctgctgaacttgatgtgacttccagcaacagagaaagtcactgggtttaattttaccctttattactaaaaggagagactccaggccgagcagcttgagaaaacgcaccaggtactttccacagcagtcatgacactgcctctcatggagaacctccctctaaatacctcaactgcaaaatatattacacaacattttctggaactgaaaagccctggcctgggagacagggtttgttggggggcagggatctaatcaccatcaatgaccagcgatagcaccgcaggcaattccttgcctcttccagggcctcagcgttcacactgcaggatggaagaggctattcagtttcaatgacctccatggtaaacagaataataactgccccacaagacggtctcatctgtatccttggaacctgtggatattccaggttacatggcaaacaggaggtaacgttgtagatggaattcaggtggtgtatcagctagctttaaaatagggagatgattgtggattatctgggtgggaccgaggtaatcacgagagtccttataaatagataagggaggtagcaccagagagctggcaccatgagaagaacttgtcctgacatgactgacatatggagggagggggccatgagccaaggaatgtgggtggctcctagaagctgagctaggcagggaaacacattcttccttagagcctctggaaggaatgcagccctgctaacccttccattttagcccagtgaggcccatctcagacttctgaaccccagaattatgaggtaataccttgatgttgtttaaaccacaaagttagtggtgatttgtgacagcagcaatagaagctttatgcaacccgtgctcctctagtcctggaatttgctgattgctctccacccatctgcagcgaacccttctcactcccctgctcaattctccctgattgagaattcccgtcttttgtctctccagccagactcaaatttccaggaggacatagatgctcctctttggtatccgtgcagtgcatcctacaaagtgcttgttcaggctccacagggcaaggtccagaattgctggaagtggcgcggccatgtcatccctggaagtgacgatgaaagccagtccttttaaggtgctcacaacctgccaggcgcagatagaggagctccccagccatcatctcactgcatctttagagaaacctggaagtagaattattagtgtcatcaccacttgacaaattaggccactgaggcacaaaggaagtgaataagctgcctgggtcacagagctgggcaatgtggtggccaggtttctactctcttgggtcatcagcccattggtttcattctctgtcacagacaatggaagttgtctctgtcttacgtaaggtcctgggcaaatgtggcatccagttaaggggaccacaagttccagtttacctgagacagtccctgtgttctagaataattattaatagtacctccccattcatactcaaagggggtctagtttgggaactgtgaatcgtatagtcagcctatgtccagccctccttccagtggtgacaggagcctcacggaagagcgcacaggggcagagtatagttgcaccccctggccccaacgggcacgaaatagagccctggaattgggcaactcacattcaagtcttgactctatgaccaatttgttctgtgaccttggggcaaacgtgatgcatttcatagcccctggcaggtttcccagcccgtactcggaaccaagtcatgggaatgtctgagaaattcaattgttgttttcctctgatctcccccagccagaatttcttcatctacaacacagagaggaaattacacagcctattggaagagaatggtgagttgggcgtggtggcacaggcctataattctagtgctttgggaggctaaggtgggaggatcgcttgaggccaggagtttgagactagtctgagcaacacagtgagaccccttctcagcaaaaatacgaaaaaattagccaaacgtgatggtgcatgtctctagtcccagctactcaagaggctgaggtgggaggatcacttgagcccaggagttcgagcctgcaatgagccatgatcgtgccactgcattccagcctgggtgacagagcaagactgttaaaaaaaaaaaaaaaagagaatggtgattgtggacatgaaaatgctttgaatgtcaagcaggaaggcacctgcaaacatgagctgggtgttttggggagacgacatatttgtggccaggtacgtagatgacctttgttccttacacttcatggactcttatttcctaaatgaaggtcaggaagaaacttcatttcctcatcaactttgcccaggtccttgtatacgaataggccacaaagtctatacactcaagtgttttcatgccagggttagacctgccccaccttgtcccagatgtgcttagccaactggctgcagagcttgcacatggggcttaacagtgaccttgactgggaacaggacccccgaggctgatgcttggacccacgctctccatgcaggtgctttgtattgactaggctttgtccctggaaggtggcctgttgtaccaccgtcatcttataccttaataattgcaacctctcctgatggaccaccctgtttcctttccttataaaatccattgtccacgcagcagagagagtgacatcagatcacgtcacattctagagtggccatttccctcttccctccttaataatcatcctgcatgctcatgagtgccctcagagtctgttttctgggactcttacttgtgacaacaccacattctctatgacattactcactccatttctttcataacttggaccacctcctgacactatattgttcatttactgccttgtacgtcctccatctgctctgtgagggagggaccctcttgaccttatttgttgggtgcctagcactgtacctggcatacggcatgtgttcaataaatgtcagttggaaggaaagaaggaagacagggagggagagaagaagggaggaagagaaggagggagggagggaggaagggaggcactctgatatggcgactttcttcagaaatgctgatatccagtgagtaggactagaattcaccactgtcatctccagtctgcagtttcaaaggaagccacatggggctgggtaagaggggagggccacagctggatcaatcattgtatagatgtggatactgtgatcggtatctttatctgggcatttttttctattaaaatttttttaaagtagtgtatttattctaggaaattcaggtgtagttttctgtcctttctctatgcatgcattagataaatctacctatccacaggtttttatcactgaatcacagtgcagttttaaaattttcacatcaatgcacacatttctgcagcatcatgtttacgggctgcacagcccctccattgtgtggttgtgtcgtattttttcactggtcccatcatttcatcatggtgattaagagaagatcataaatgcctgagttcaagccctggcccttccgcttactcactgtggaaccttgagcaagtcatttaatttctttgtgtcacagttataccacctctaaaaacgtgatagcaatagtatctacctcagggttttttttttttttttttttgagaatgggaagacttaaaatatgcaaagagtttagaaaagggccggctcatgatcccctaagctctggccccagatgctcctttcttccctctctgtcttccttctgtaggtgctggtctatgcctgagaccccagtgaccactgctgcctctctgactcccaaaaagtcacttccagttgttctcccttatctgagtttcagatccatgtattcaactgcatattttgtttttccctctggttgcctctactttattaactcttcctttcacccatctacccatccacccacccatccaccacccaccatccacccaccccttcacccttctactcactcacccacccatccactcattcatgcacctgcctatcgccccatctgcccgtccatctgcccattcatccattcaccagattaccaccatgctctacagcctctcattggaagaagttgtacgccaacattccttgaatagattacaagagcccaaatgatcagctcccaatacttcctgacttcatctcttgctactcttctccctcacttgcttagtttcagccacaccagcttccttgaggatcctcaaccactgtcaggcacacaactgccacaggggctttgttcttgccttttccttgtttccttgcctggaatattttgcctaaattatccacataatcacctgctctcttcctataatgctttgctcaaatgtcaagttctcatagaagctttcctgacacccttccccacttttttagaagcagggtctgtctctgttgtctaggctgcaatgcagtggcatcatcacagctcactgcagccttgacctcctgggctcaggagatcctcccacctcagcctccagagtagaggtgtgcaccatcatgcccagctaatgttcctatgttttgtggagatgaggtctcattatattgcccagggtggtgttgaactcctggcctcaagcaatcatccctctttggccacctgattagccggtactagaggtgtgctaccatgtctggctaattttacaaaaatatttgtagagatggggtcttactatgttgcccaggctgatctcaatctccttggctcaaaaaatcctccttcctttgcctcccaaaatgccaggagtacaggtttgagccaccatgcccagcctgacctctctttttaaaattgcaaagtactccccgcaaactatatctccatctcttcccttattgttcttcataaacccaaacacaatctgacatgttgtgtatgttacttatctatcctgttcctactctgtctgccctgctagaaggcaagcctcataagggccaggagttttgctctttttaaaaactactgtatttctggcaccgggaacaatatctgtcatatagtagccactcaatgaaagaaagaatgaatgaattcaggcaagaaatggtaccttagagtaagtttatgaaattgaaaaatgaataaatttcagagatatcgaaagaaaagtttcccattattgtttcttatatccaataaactttttctttgtgccttccatatttatgtttacaaatcccccaatattatgtaaaattcatttatttccttccaggacttacatgttttctacacttaatttaccaacatatccggagtgtattttgatgtacaaatgagatacggatcagatttaatatttttatctagatcattaagcaccttcaaaatgatctgaataccatttattgaataatccatcttcctccaaataatggaaatgcaacctttatcacattgcaaagttttatatctgcaggtctttttctgaattttctattgagttttcttgctttgtttccaatcagcctgacacttcagttattacaattccgtgtgtgagaatacctggtatagctaaatccataatttcttttcttttctaaaaaggatttttttatgacttaagttttcaaattcactatagaccatttccctcatgataatttactggaatttcacattttatagattgagaggaaggaaataggtatcaagtcaatattaactcccatgctatgcatgttattatttgattttttgtttttatggttttattcatatggatcccaaagacttgctataataatatcaaaatgttgtatgttgcagtttaaaattggatttgtttctgtttgtggtttaactaccattctttttgcttttgttttttttgagacaggttctggctctgttgcccaggctggagcgcagtggcacaatctctgttcactgcaacctctgcttcctgtgttcaggcaggctttctgtctcagcttcccgagtatctgggactacaggcacgtgccaccatgtccggataatttttgtgttttttgtagagatggggtttcaccatatagcccaggctggtcttgaactccaggactcaagcgatctgcctgcctctgactcctaaattgctgggattacaggcatgagccatggcgcccggccacatgctaattgtgtagcccattggaattctggccacaattacaagctccaaaacttcttgtagattctcttgggttttcctagtaggtcatctgctaatactctgttcaaattcctgcacctctcactctctgcctgagcatctgggtactgaccatgtgctgccctgtgacacttttcccatcactatcctgaatgtcacttggtgccactctttctgttcagcaagttacatgtttgtgtcttggatctacatcttgattttaaggttctgtacatccggcccagagctgcccacactgcagccacctaatcaataagtgttgatttatctgattaaagagcaagactagaggtaagaaatccatgagctgagttcttcctctcatgtactgagagcgttctgagtccggatgtgtcacaggcgatttttcaaatagtaggcaaaatttggaatctggctaagggttcagtccttaggaacagcaagccttgtgtaatactcatggtgctccaggtattggtctatggactttatgtatattaactcatttaatcctcagagcaatctgatggaatcggtgccattattgtacccgtttttcatgtgaagcttttaaacacagagaagttaaatcacttgtcctaggtgacacaggtacaaaaagacagccaggattccaaccgaggcagtgtgtctccagaattcgtgttcctaaccatcacacctactgtctcttggagggatacatgtacaggttttcatgttggtctcatcagtacaacctgttaggcaacctcctgactttgaccttttgggtgccaggcagttttcagtccaacccaacatacctcttcagtctattctagtccccgttttattctctctctccacaaacagcctagcctgcctgacctggaaacaaagactttctcctatttttcagggccccatttctaaggcaccagctggagctattgtgtaattagagcagaagtttaccctacccccacagagcttgggtcgttctgtaaaatcattattaaatgactgcctttatagggccctgggcagaagtaagaattacagggctcttgataatagggaacgggatgccaagcagcatggcctggctgcatgtgcagcacttggtttcaccaccagctgatcaacaggttgccagtgaccttcctggtgatgtgattgatcacagaggtggtgggtcttgtggggaatgccagctgagattcccagctggactggtttgtctaatggttctgatttcctgttgtagaaaacaggagctaatcaaaggcttggctgttgatgcttccagttaagcagcttgaagcaccggggagcatcccatgtctcactccacctgcatcagggtctgtcaacctggtgataatccatgtatatccaggtcttcaccctaatgcagataaacactgatctgtgggcagcatccactttatcaacctggctcagtcaatcctgaagaccctcttctattctagaacaatggagcaggacaggatattggagatcaagttctttaatccatatttttactgacaagcaaaaggttggaccaaataggcagggatgaaggtagatggaggggtatagagccaaactggctttctgcaataggaaattggaatatgtaatgcccagagctgccctccccagtcttttcctaaaaacattggtattttcctttttttttttttttttcctgagatggcgtttcgctcttgttgcccaggctgcttcaacaaaaggttcaagaggtggagggctagtcccaagaccacacaggaagcccatctgagaagatctgatcctctcttcctgggggatcttctccaagataaaggctttaaacatctctatgcgcacagctcccacatttgtatctctggcctgaaattcccctggattcagaactcatgcactcagctgtccagacatatcaagacttaatctgttcaaaatgaaactctttattcctgtgctacaatctgaatgattatgcactcccctcccccaaatttatatgttgcaatttgaactcccaaggtgacggtatagaaggtgggcctttgggaggtgaataggacttaggggtagagcctcgtgaataggactaatgcccttataaaagaaacctcaagggagttcattcacccccttctaccaggcgaggatacagggataaggtgctaactgaaccaggaagcaggcccccgtcatccactgaatctgatgacactttgatcttggacttcccagcctccaggattgtgaggaagaaatttctgttgttgacaagcttcccagcctatggaattttgttatagaagcctgatcagactgagacatcctctgtctaaacctacttcttctgcagcctttcccatctcggcccaagcaagtccattcttccaggtgctcaggaccaaaccctgggcaccatctttctcttcttcctttctcttatatgccacatccagtccacctggaaattgtgtaggctttatcttcagaatatatcctgagtccagtcacttctcaccacctccactgctcccactttggtccaagctactattagctctcatccagtttttgcaacaaccccctcactggtctctcacctcctgtcctccacctgccacccccatcctgacctcttcgccttgtcagaacattctgtgtgatacattgatacacagagcagactcatgattcatctgcttataatgttccgctgatttcacatctcattctgaaggaaaggtgatgggggagaggaagagagcaatgggcaagagttcagagaactggctcccatgccaccctcatccctgactctggaaaagtgggcatctatctccatgacccagtttcctcttcatatggtttgactctgtgtccccatccaaatcttatcttgcgttgtaatcaccacatgtcaagggagggccctggtgggaggtgattggatcatgggggccatttccccatgctgttttcgtgatagtgagtgagtgcttacgagatctgatggtttaaaagtgtggcacctcccctcttgctctgtctctcctgtggccatgtagagtgtgccatggccttctgccatgattgtaagtttcctgaggcctctcaagccatgtggaattgtgagtcaattaaacctcttttgtttataaattacccagtctcaggtagtatctttacagcagtgtgaaaacagagtaacacacctctcatctaagatcccctcttgttttaagttgttagatgtgtatattttaagaggtggaggagtcagcagtctgtgtatccccaaaactctcctgcacccctctctgactctgcttggacctgtccttcctgatccactctccagggctcctggcccctttgccctcatcccctcctcctccggcttcacaaagatccatcattccttgcaggcctctgctgattcacaagctcccagagactgtggcaacagctgcctttgaaatattgaaaatgaaaaaaaaaaaaaaagcttttcaaaaagtaaacaaatgcacaggagagtgggaaggagttctccagcgggaagtggttggtgactatattgatacaagggaggtgaatttattttcttttttctattttttttgagacggagtctcggtctgtcacccaggctggagtgcagtggtgccatctcggctcactgcaacctccacctcctgggttcacgccattcgcctgcctcagcatcctgagtagctgagactacaggtgcccgccaccacgcccgactaatcagctaatttttaaatatttttagtagagacagggtttcaccgtgttagccagggtggtctcaatctcctgacctcgtgatctgccagcctcagcctcccaaagtgctgggattataggcgtgagccagtgcgcctggcctgtgaatttatttatttatttatttatttatttatttttatttttttcgagacggagtctcgctctgtcacccaggctggagtacagtggcatgatctcagctcactgcaacctccacctcccaggttcacgccattctcctgcttcagcctcctgagtatctgggaccacaggcgcctgccaccacacccagctaatttttcgtatttttagtagagatggggtttcaccgtgtcagccaggatggtctcgatctcctgacctcatgatctgcctgcctcagcctcccaaagtgctgggattacaggcgtgagccatcgcacccggccatgaatttattttctaaccaggctatgcaagtgcaaaaaccaagccaggcaatgagttcacaacatcctaaaagtaatatctgactatgtggaaaaggattaaagtctacatttactcaggattctccaaaacagatctgaggcagatctccaaaccattacctctggatccctcccacctgctatctacttaagttctagcctctctctcaagccccagactttatttgctgtccatttaaacctggaagattcaaacaaaattaccttttctttcccatccccgatacagcgtctccccagactttcctatttccatgcagaccccactatcctgtgagttgtccaggttcaaagacattcctgtcatctgtggctccctgggggttgattaggatgttttgggcaactgggaacagcacctcctaccatcagcagtcagaaaataccaatgctggctgggcgaggtggctcacgcctgtaatcccagcactttgggaggccaaggagggcggatcatctgaggtcaggagttagagaccagcctgaccaacatggtgaaaccctgtctctactaaaaatacaaaaaaaaaaaaatagctgggcgtggtggtgtgcgcctgtagtcccagctactcaggaggctgaggcatgagagtcgcttgaacctgggaggcggaggttgcagtgagccaagattgcaccaccgtactccagcctgggcaacagagtgagactctgtctcaaaaaaaaaaaaaagagctttacttactctaaataatattttgtgtccatatctacacatagataacaacaaatcactatcatttttggtatgggcatgtgtagatataagtattaaatcaatttcctaccttttatccagttatggttatatcccctatcagtgatgtaacttcagccaagatagaaatttatctcacaaaaagcaagactgggatgggtgcaatggctcacacctgtaatcccagcactttgggaggctgaagcgagtggatcacttgaggtcatgatttcgaaactggcctggtcaacatggtgaaaccccgtctctactaaaaataaaaaaaattagctgaacatggtggcacacacttgtaatcccagctattcgggaggctgaggcatgagaatcacttgaacctgggaggcggaggttgcaatgagctgagatcacgccattgcactccaccctgggcaacagagcaagactctgtctcaaaaaacaaaaaagtaaaaacaaaactggaagttgtcagtctagggtggcgttagggactttcatttccttccagaggacattctgctatccgcagggtagaagcctaatcctcaaggttcaaggtgacaagaatagctccaaccatcatatgcttattccaggaagcaggtcaaaggatgaacaactaagaaatgacactaaagatatatgtcagcccatctgcattgcctaaaggaataactgaggctgagtaatttatagaagagaggtttaattggctcacagttctgcaggctgtacaagcatgacaccaccatcaactcctgaggaggcctcgggaagcttccaatcatggcagaaggtgaaaggaagcaggtacatcacatggcgagagaaagagcaagagagggaggaggacatgccaggccctttaaacaaccagatctcccataaactcagagcaagaactctgtcattgccactgggacagcaccaacccattgtgagagggatctgcccacatcaccaaaacacctcccaccaggccccacctccagcatcagggatcacatttcaacatgagatttggaggggaccaacatccaaaccatatcaagacagaagttacagaaaggggtttccaaaaatgccacccaatacttttattacctcccattggccagaacctggtcacatggccacaactcatggcaaggaagcctgggaaaatgtagcctgtgcccactcactaggagaggggagcactggtgccagggtgcaggaacaccagtgggcattcatacttcctacttcgtcttataaaaatccttagagattcatctttgtgtatttttctgactatttcctagggataaatgcctataaatgaatttgggaccaaaagttatgcactttcattggccaattgccaattgccctctagaaagcttgtactaattaactcacacaagaggtggggttctatttcatgaaatgtttctccaccccatatttccttttaatccacaccctttggtctttattaggcttacacatctcttcagaatccctgcttcctacattataatcttgggatttaatacatgtttttcattcaggttattatcaatatcagatttatctgactatgcatgaacacagccacagattcagggaaaaagatgtatctttcagcgctgaagagaataaaaattaataatcctcagagactttcaaactgaagtgggcagggaagggtggaaagaaccgatctcattctatgaagagcatgcagggattttcacagagcatgtagtgctgagtacagcacaccaggcacccggggacacccagagagcagcctttcctcaacacaagaggagtgagcaccgcacagagctgcagaaagggaatcccagatggggtaacagcagatacaaagaccccacggcaggccctggcctggcctgctggaggagcagaacggaagccagtgggtctggagtaaaggggaccaacttgtcccggtttgcccagaactttcctggttttaacactagaaatcccatgtcccaggaaacttctgagtctcagccaagctgggatgatttgcctagaacttcccctattataaaactgagaggtctgtgccccatcatccgcctcagtcctaagcaagctgaggcagtgggtcgccctagactggagcaacgtgcatgatggtgggaagagccagtgactctctttcatgtcctctctgccctcgatctcaggagtcacccaggtgggcactggcatccaggatgaaaacttcccagcaccccagcagtggccacgtgaccaggcagtggccaatgcacatgaggccagtgcacagcaactgccattagaggaaggaagatttgtgtcctcttgttctcttctcccctccctgctggctggtagtagataggatggacactgtgggggaagctacaccctaaagaagtcaaagcagcaagatggaagtaccctaagaccctgaaaaatgcacagagaagaatcacccgactggcttgaactttcatgtgaaaggaatgaacctctgtcttagtaaagccaccgtgattcagggtccttgtgatattcactgaggctgtaacataattgttgaaagaacaggagcgggaggggagatggagtcggagaggcaggcagaggtcagatcacatggggcctgtaggccaaggcggaggaagaaacaggtgacataggactcaaggaccccacctgctcccaggcgaagggagtttgctgtgggtgcccctccctgtctgtgtgtccagtgtattcatattcttcataccttgcccatattggacaaatacttttttctattcaatatttagaagacattgcattaaatagcaagatggcaggtgaacatcaggaaggaacattaggaacatccacggcgttccatccaggaaccttcaccgtggaaactcttgtgctcatgggcgtggtctcaagacacagtcagctgttggggatcagaggcgacactcattgtagcagagaggcaggaccaactgggagagggtccttctgtgacaactattgcatcaccgggctgtgtgaagtgactcagctgccagaactcacacaatatcattctacaccaaacctcacgggaaaaatggtaagtttaaagttttttcattaatagcaactctcagattaatctctgtcctccatcgcttctccatgaaacaactttttatagctttggttgggtctatttttccatttattttttattttactaactgatttaaagatatatattttgtgtgtgtgattttgtctctgtcagccaggataatcatgttttaattcctattattattattaccaacatcctttagtttttttagcttttcaattcctaagggtattaatcaggatctttctgtctcgtgagatggaaaacaaatccaaactgtgtaagaggaaaaagaatgcactgatcactagcattgagaagttcccaagcttagcttgcttggggtacagctacgtctaccatttccagggtcatcctgtaactctctctctctacttccccaactttggctccatgtttagctccacgaccctcagacttaaacagcagcactggctcctccccagatctccagctccctgaccctcaaactccaactccaacaccagctctgccccaggtctccagctccacaatcctcaaactacaacagcagcaccagctcccctggggatctccagctcaatgactctcagacttgggaggcagctccagctcccaccaagcctccagctccacaaccttcaaactagaacagcagcaccagctactccctgggtctccagctccctcaaaattcaactatagcactggctgttccccagcgccaccagctccacaaccctcaacttacacggtggtagcaccagctcctccctaggtctccagctacacgaccgtcaaacttgaactgcaacaccagctcctcttcggcctccagctccacaatcctccaacaacaacagcaacaccggctcctccctgaatctccagctcaacaaccctcagacttgagaggcagcaccggcacctccccaaggctccagctccatgaccctcagatttgaacagcggtagcaccagctcctgtccaggtctccagcttcatgatccttaaactagaacagcagcaccaccacctccctaggtttccagctccacgaccctaagacatgaatggcaggaccgggttccccgctagggctccagctccaagacccacagatataaacggcagcaccggctcttcctgggatctccagctccacagccttcaaacacgatcagcagcaccagctcccctctggttctccagctccacaatcctcagacatgaacagcagcacaggctcctccttgggtctccagcttctctaccctcagactagaacagcaacacttgttcctccctgggtctccagctcttacaagtctcagacttgaaaggcagcactggctcctcagaaagtttctggctccaagctggtgctgctgtcctagtttgaaggtcatggagctggagacccggggaggaaccatttgaacagcagcactggcccctccccgggtctcaggctccacgaccctcagacttaaaaagccgtagtacgggcttctccctgggtctccatctctacaaccctcagacatgaacagcagcagcaccgccccctccccctgtctccagttccacgaacctcaaactacaacagcagtaccggcctctccccaggtctccagatccacgaccctcaaaatagaatggcatcaccggctcctccctgggtctccagctcccaaactctcaaacttcaattgacacaccggaccctccccacagttaaacagcagcacgggctgttccccaaagctccagatccacgaccctctgacttaaagggcgatagcaccaactcctccctaagtctccagttccacgaccctcaaactacacagcagcaccggctcctccttgggtctccagcttcactacactcagactagaatagcaacaccggttcctccctggaactccagctcaatgactctcagacttgaaaggcagcaccagctcctcaaaaaggttctggctccaagaccctcgaactagaatagcagcagctgctgcatcttgggtctccagctccacaaccctcaaagtagaaaagcagccctggctcctccccgagtctccaactcctcaagtctgagggttgtagagctggagacccggggaggagtcagtgctgctgttctagtttgagggtcatggatctggagacccagggtggagccggtgctgctgttctagtgtgagggtcatggagctggaagaccccgggaggagctgctgctgctgttctagtgtgagggtcatggagctggaagaccccgggaggagctgctgctgctgtcctagtttgaaggtcatggagctggagaccccggaatgagccatttgaacagcagcactggcccctccccaggtctcaggctccacgaccctcagacttaaaaagccgtagtacgggcttctccctgggtctccagctctacaaccctcagacatgaacagcagcaccggctcctccccctgtctccagttccacgaacctcaaactacaacagcagtaccggcctctccccaggtctccagatccatgaccctcaaaatagaatggcatcatcagctcctccctgggtctccagctcccaaaccctcaaacttcaactaacacagcagatcctccccacagttaaacagcagcacgggctgttccccaaagctccagatacacgaccctcagtagcactggctcctcccaaggtctccagttccatgaccctcaaactacacagcagcaccggctcctccccaggtctatagctccaccaccctcacactagacatcaagactacctccttcccgctctccagctacacgaccctcaaacttgaacagcagcagcagctcctccctagatttccagctccatgaccctaaacctgcaacagcagcaccagctcctccctgtacctcaagccccatgaccctctgacttgatcaacagcaacagcagctccctccctggtctccagctccacaaccttcagccttaaacagcagcagcaccagctcctccctgggtctccagctccacaaccctcagactagaaccgcacccctcctccctgagtctccagctccatgaccgtcaaactacaacagcaacacaggttcctgtctggatctccagctcagcaactctcagatgaggcagcaccggcaactcaccaaggctccagctccacaaccctcagatttgaataatggtagcaccagctcctgtccagatctccagcttcatgatccttaaactagaacagcagcaccgctgcctccctgggtttccagctccacgaccctaagacatgaatggcagaaccggcttcccacaagggttccagctccaggacccacagatttaaatggcagcactggctcttcccaggatttccagctccactaccctcaaactagaagaggagcaccggctcctccctgggtctccagctcccaaaccctcagacatcacctgacacactggatcctccccacagttacatagcagcacgggctgtccccgaaaactcgagatccacaaccctctgacttcaatggcggtagtactggttcctccctaggtctccagttccatgaccctcaaactacacagcagcaccagctcctccccaggtctacagctccaccaccctcacactagacaccaggactacctcctccccgctctccagctacacgacccgcagatttgaacagcagcagcgtctcctccctgtacctcaagccccataaccctcatatatgaacaacagcaataccagctaatgcctagggctccagctccaggatccacagatttaaactgcagcaccagctcgtccaaggatctccagctccaccaccctcagactagaacaagacctctactccctgggtcgcgagcttccggaccctcgaactatgaaaacattgctcctccctgggtccgcagctccacgaccctcaaaccagatcaagatctctcctccctgtgtcgtcagcttcctgacccttgaactatgacaacattgctcctccctgggtcagcagctccacaaccctcaaaccagatcaagatctctcctccctgggtcgccagcttcctgaccctcgaacaacagaaacattactcctccctgggtcagcagctccatgatcctcaaactagaatgagacctctcctccctgcgtcgccagcttctggacccttgaactatgaaaatattgctcctccctgggtcgggagctccatgaccctcaaactagaacaagacctctcctccctaggtctgcagcttccagtccctcaaataacaacattgctcctccctggatctgcagctccacgaccctcagactagaacacgatctgtcctccctgggtcaccagcttccgaaccttcgaactaaaacaacattgctcctccctgggtctgcagctccacgaccctcaaactagaaaaagacctctcctcactgtgtcgccagcttctggaccctcgaactacaaaaacattgctcctgcctgggtctgcagctccacgaccctcaatccagatcaagatctctcctccctgtgtcatcagcttcctgaccctcgaactatgacagcattgctcctccctgggcgcaccctcaaactagaacaagacctctccaccctgcgtcgccagtttccggagcctcaaactaaaacaaccttgctcctccctgggtctgcagctccacaaccctcaaactagaaccagacctctcctccctgtgttgccagcttcctgacccttgaactatggaaacatggctcctccctaggtctgcagctccacgaccctcaaactaaaacaagatctctcctccctgggtctgcagctccacgaccctcaaactaaaacaagatctctcctccctgtgtcatcagcttccagtccctcaaataacaacattgctcctccctgggtctgcagctccacgaccctcaaactaaaacaagacctctcctctctaggtctgcagcttccagtccctcaaataacaacattgctcctccctggatctgcagctccatgactctcagactacaacaagatctctcctccctgggtcaccagcttccggaccctcgaactacgaaaacattgctcctccctgggtctccagctccatgaccctcaaactaaaacaagatctctcctccctgtgtcatcagcttccagtccctcaaataacaacattgctcctccctgggtctgcagctccacgacccttaaactagaacaagacctctcctcactgtgtcgccagcttccggacccttgaactatgaaaacattgctcctccctgggtccgcagctccacgaccctcaaactaaaacaagatctctcctccctaggtctgcagcttccagtccctcaaataacaacattgctcctccctggatctgcagctccacgaccctcagactagaacaagacctctcctccctgagtcaccagcttccgaaccttcgaactaaaacaacattgctcctccctgggtccgcagctccatgaccctcaaactagaacaagacctctcctccctaggtctgcagcttccagtccccaaataacaacattgctcctccctggatctgcagctccacgaccctcagactagaacaagatctctcctccctgggtcaccagcttccggaccctggaactacaaaaacattgctcctccctgggtctgcagctccacaaccctcaaactaaaacaagatctctcctccctgtgttgccagcttccggaccctcgaactatgacaacattgctcctccctgggtctgcagctccacgaccctcaaagcagatcaagatctctccttcctgtgtcatcagcttcctgacccttgaactatgacaacattgctcctccctgggtctgcagctccatgactctcaaactagaacagcagcaccagctccttcctggacctccaggtcaatgactctcagacttcaaaggcagcagcagctccacccccaggctccagctctaaaaccctcagatgtgagcagtggcagcaccagctcctttctgcgtctccggcttcatgatccttaaattagaacagcagcgccatcttctccctgcgtctccagctccaggaacctcaaactgcaacaggagcacctgttcctctgggattttcacctccacgaccctgaggtgtcagtggcagcactggctcctcccctgggctgcagctccagaaccctcaagaataatcccttctcatgaaatgtagcagtcaggaaaactgcagaggaagtaaataaataaatgttttctttcaaactgatgtttcttttatattcacacaagtcaggaaacttttctactttccatcaaccttacaatctacttatattcaattgtaaggtggaaatccaccatttgaaataacctttaaaaacttagtaactctcttttactatgattttatctcacagctctagaaacgatctttcactttgcctgtgcagaagtcttgtgaacattcaaactagaatttacttggttgagattctagaatacacgttatccccagatgttcctgccctccttaaaatcttctaacatgttcccctcacccgagcataaatgccaggtcctatccacagcccacagtgcccagcacggccctgccctctgccctgaccttatggtctcccctctgctgttactttcctcccagacaggcctctgtcacttcctgaaaccacacaggctcaggcctgactccgggcctttgcccctgctgtgccccctgcgtggagcgcctttgcccggctccccatcctcctctccacccgctcagctccagcctgctggctgcccctcagtccccgcccctcagcggggaggacatccagaacacacgatgtcctccccgctaggcctttgcacatgctgttctctgtgcctgaaacccctcccccctcaccatctgcgttcacttttctaatttccattcatccttggagtctccactgaaatatcgcccccccgcctgcccccaccacttggacttaaccttgcttaggttgaaaacccccatctcctgagtccaggaagctagatgctgtcctggcacttggaactttcccatcacagcgttttgcgcactcgtaatttattctattaggttggtgcagaagtcatcgcagtttttgtcattactttcaatgaactgcagcgccggctcctccccacttttgattgccattacctttactggcaaaaaagtgctggaattactgctgcaccaacctaatagaataatttatatttattgatccatcatatgtcttcccctctagaaaataagctccataagaatagtgaccaaatctactccaatcactccagcttccttgcacattgtcaataattatttaccgactgactgatagagaaatatcttcattgttgctgggatgagccacataacatgacacgcccctttgaaagtcaatgtcatggacagttagcatttgcttttcactcctgcacccgtggcttggctgggcttaggctgatctagtctgggcttgactccaggctgagggttggaaccctgcgtgctccacatgcctctcatcctgcagctggagccaaagttccctggggcacgctcgtctcgtgggaaaaatcaagagcattagagggcaggcctggcagtgccgacacattccaggcttctgcctgtgccgtgtctacgaacatctcattggcataagcaattcacccagacacgagcaatacctccatctcaaaagataggaaaagaaaataccagtgtttttaggaaagaaaataccagtgtttttaggaaaagactggggggtggggtgcagatctgggcattacgtattccaatttcctattgtagaaaatgggagctaatcaaaggcttggcttcaatgcttccagtttaggatcaaagccaaaacaacgaaataggggcaattcaaaggaacaccctctttacacctgttatttttataagaaatgaaaacctttcttaggagacctgtcacaatcctcttcggtcttttgggccagaatgagtcatagggaagtcctcactgtaaagggagctgggaagtatctggcaaaggtgactggcatagccaaggctggttttgaccaattgtgatccatttccattttgcctagaaaaaaatcctgttagcaagtagggtggggacagctgttgggtgagcaaacatcagcacctcctactttatcttcttccaccgccagcatccaatccaggggacagcctgttgttccctccctcagatgcctcctctattggtcagcttgttttcttcctatgcctggtaccttcattggcattgcaccttctctagcctggaccataattgcccttaataccctacctcctgtcctttctctttcaaaagactgacagatacctgatctctcaagtacaattctaacttgattactccagcacccaactatctttgataactctgtctcatctgccaagttatatacaaaccttctcagggtgaaaaccaaggccttccataatatgatcattggtaagggagaaaaaaaaaaaaaacagtcctgtttgcatctagactatggagggaactgagaaacacaaccctccaggccatgatgctcctgagtcgacatgaaccacactcaaagaatatgaactcgttcagacaaggccacaagttgactgtgtttagaggtaggcagggataagaccactctgcagccacagaaatgactgaacatgccccttttctaacatgagtgacagctgcctctttaccagtgacaactctagcctgcttcaagcttcccactcctgagataaagtatttaagatacgcaatcaccaagttgccctcacttcttgaccttgcctccttaatccctttttggaaccattctgtagaagcctaggtcctctaaaaagcactgccccttcccccttactgagatgcccccaggtggccatgggcgtgggaatctccctgactgcagcaagctaaataaactgactgtgactgcagggaagttcctggcagtcttaggtgggtgggctttaacatcatgatctaactttacaactttacaactgttccccaatagcttctttatagttcagacttttttttttttttcacaatcacacttaattctgaacaagttgctggatccagctgctattttgcaagaaatacacaggacagagacaggaatgtgctgactgcaccataaattcggattcgccaaaatccagactgtgaaaatctttataggtcacagggttcaggcactgtgacaaagaagttttaagaaaaagacaggcatggaagggaaatctggaaatttaagagacttaccaagatttaccaaatgggtaacgtgaactatgctgtctagggagccacatgggggtgattaagccatgcagattgtagggaggttgttgactatgagaatcagcatgagggttacttttggagggaggaagggacagactgtgattgggatgcagccgtgaaggggactctggccaggtgctctttcttgacttagtcttggtgataagaatatttgtgtataatatctcactaagctatacatttttgtgttttttttgtacctgtgtttgattttaaaataaaaaggctaaaaagaatatccttgaacagtttcatttctgtacataggagtctatagacaagggaagcaagaagtcaagttagggagctgtcagcaaaccaggagaaggatgatggggcttaacccacgatgacagcggcagagaccaggagttgcattcagattccaatgttttggaagaaagaaccaacaggagcctctgacacattgaattgaacatgggagaagaaggagaagcaatgttatactgtcacctctttctgactttattgtgaacctggtgaacataatggccaatcaaagacattggagtggatgagatgaaggtttcacaaaagtactaaagaaaaagctattgtctatgggcagatgacactagtccagggaggaaaaaaacggtagcgagtagatgttcttttccaccaaaaggtatcgtgcctatcgtggaagctcctggtagacatttgctggaaacagcatagcccagagacattggaataaatttgagatgtcttgaaactataatacccaaatctgactatctgttcagtgctgaaatctgactatctgtcatatttgggtattatagtgtcataagtgagtgtcataaaatgagttaggagtgtttcttctgcctgtattttctgaaggtgcttacgatcgatgttatttcttaaggagggctgagattgtcagcccaacacttcagatatgcattgcccttggggcaatgcccttgatggggcatcaagaccccgtgtctatttcacttccgaaattcaagataaacaaggcagccttttgttggagctcattgcccatttgttgaattgaataatccatctctcctccttaaaaaagtcaagttcataaaataaggaagcaagacttctaaatattttatgggaaaagattgtcaataaccaactcttttacattatttttataggtcacacttaaattggcaaaatagcaacgtgcaggtatgtgtcttatgaacgtctgctttttagcaatgagaatcctattttcctactggcttttgttattatttctgacacgtctaacttagtttttgctctcttactagctatagggttttctcactctgttgctcaggctggagttcagtgccacaatcacagctgcctgtcaccttgaactcctgggctcaagcagtcctcccacctcaacctaccaagtgcctgtagtagctacaggcatgcaccaccactcctggttaatttttttgtttttaaaaatagaattgggggtttagccatgttgcccaggttggtctcgaactcccatcctcaagtgatcctcctgcctcggcctcccaaagtgctaggataacagatatgaatcaccacacccagcctgtggtaatacaatttttaagccgacattttcctggactaaaggagctgttgaagtctagactcctaggaaaatcctgatgtcctgcttataaatagacatcctatttgagctgagttattttgcagaaaggctgcctgcagctttaaatgggctccccaacctcagattctgggaagttggcagccagctgcactaggagtgagttatgatgtcagctttccagaattcctaatgaactccagagcaaaaaatgctgttgctctgcctcccccaagtcacatttctagttgattaacgagcaaaggagtagaaaaatctatagctttggagaaggaggaagagtgaaataatttctcctctaagaaaccacagtgccccgattattttatttgttaagaaaaaggaatttcattttctatttatttcctcctttaaatctagattcagacccccgcttcccccttcccagtcataaaaagcaggtttggctctatacccctccctttaccttcatccctgcttatttggtccaagatagaaaatccagccctgcccttttgggggcagttgtcttagctctttgaggtctgtttaaaatctcatctagcatacataaaatagatctgcaaccctccattaaaagtcatggcctcctggctgcaaagagatacatccgggtgaaagttgtggttggttatgtccagctcagcccttctgtggccctgccccagcatgggctgaacatcttcccaccagctgggacatccagggcagctgatcttttaggggaaaatcactctgcacaattaccctgctccatatcccaccttctgtaaggctgcttaggctaattaaaagtcatgcttctttggagaaatgtctattgaaatccttagccattttttaattgggttattagggattttttgctataaagttgtaggagttccttatatattttggaaattatcccttatcagatacatagtttgcaaatattttctctcattctgtaggctacctttttactctactgattgtttccttcgctgtgcggaagctgtttagtttggcatcgtacttgtctatttttgctttagttgcccatgcttttggtgttgtatccatgaaatcactgccaagaccaatgtcatgaaattttcccctatgctttcctctaggagctttatagttttagatcttacatttaaggctttaatccatttttaggtgatgtttgtaaatggtgtaagacaaagataaggatctaatttcattcttttgcatatgtatatccaattttcccaccactatttattgaagaggctatcctttccctattgtgtattcttggcacccatgttgaaaatcatcctaccatatatttgggtatttatttctgggccctctattataattccattcatctataggtctgtctttatgccagtaccatactgttttaatgactataactttgtaatatattttgtgatcaggaaatgttatgcctctggttttgttcttgtttttcaagattattttgggtattctgggtcttttgtggttccatataaatttctgaatttttttgtatttctgtaaaaataaaattccatgtgattttgatagggattactttgaatctgtagaatgcttagggtagtagggacactttaacagaattaagtcttccaatccatgaacatgagacatctctccatttgtttgtgtcttctttaatttttctcatcaatattttgtagttttcagtgtacagatctttcacttccttagttaagtttgttcctaagtatttttttaatgctattgtaaactggattgattttctaatttccttttcagatagtttgttgtgagtatatagaaacacaattgatttttgtatgttgactttgtatcctgcaactttactgaatttgtttattaattctaacaggttttttttaagagtttttagggttttccatatataagatcatgccatctgcaaaagggaaagcttaacttcttcttttccaatttagatgccttttatgtctttttcttgacttgttgtgttggctaggacttccagtactatgttgaatagaagtggtaagagtaagcatccttgtctttttcctgttcttcctggaaaagctttcagttttttaccattgagtgtaatgttaactgtgggcttttcatatatggcctttattatgttgagttaataatttttctctatgcctagtttttgagtgtttttatgataaaagagtgttgagtttcatgaaatgctctttttgtatcacttgacatgatcacgagatttttctccttcattctgttaatgtggtgtctcacatacaatagctatatgaaaagatgctcagcatccctaatcatcaggtgaatgcaaactaaaaccaaaatgagatatcaccacacatcattttttaggatgtctattatcaaaaaatcaaaagacaacaagtgagaatgtgcagaaattggaaccctgctacactgttggtgggaatgcaaaatggtgcagctactatggaaaaatgcataaaggctcctcaaaaaaactaaaagtaggactatcatatgaaccagcaatctcatttctgggtatttattcaaaagaactgcaattaggaccttgaagagatctcagcactgccatcttcatcgcaacatcgttcacagtagccaagatgtgaaatcaatcttgattgatggatgaatggatttttaaaatgtgatgtaatatatacatataataaaatattattcagccttaaaaaaaaagaaatcttgcaatctatgacaacatggatgacccttgaaagcattatgctaagtgaaaaaggccagtcacagaaggacaaatactacatgatttcatttatatgaggtatcaaaaataggcaaactcattgaagcagagagtagaatggtggttgccagaggcttggggggagggtgaaagggaaactttctaatcaacaggtgtaacattacacttaagcaagatgaataagttctagagatctgctgcctgacattgtgcctatagagagcaatactgtattgcacacgtaaaagtctctacaagggtagatctcatattaaatgttcttaccacaatttaaaaaataagaaattgaaatatggtcccttcaatagaggccttgggatattttctagacacaacccacagtcttcttcaggaattaacttagcacttgtggccatcatatcctcttccccttagttttcctagtaatatgtggtttgtttacatattttacccagatttaataaagatattcaatcataacagtgttttttaaagtcaatctgtgtgcaattttaattaggatttgcatcaggctgggcaaagctttgagagggagaggaaactgagagctgggcattcatagggtgggggtagcagggagggcggggggccagttactgataacttccctgccatacacagactgtggaggacaacagacacgtgtccgcattccgaaaaacagaggagctgggaagttgggagtcccatttggctggttggctcaagtctccattagctggggtttctggaattttccctcactgcagctttgatggtgggggtctgcacaccccaccccattaacaacaagaaagaccccgagtctcaggctcccatccacccctggcctgaggagtcacgccctcggaattttgcttttagacttttactgggcccagggtgggttatgaacagaagcagaatggctactgcccagcaaggcgtgtgctgttccactcagctttgaccacccaggatcaagtgaattagcacagtgcctgacaaatcctgagggtagctattatgaatatgaccatgttgtgtttcctctcctgttttcagtttttgggagatcagaaactcggcttacctttgtattctaagggcctagaaaatttttgtcctataattgtggctcagtaaacatgtttgttgatttcctcatgagtgagatactcaacagagccctctgtaaacaggaaaatatttacatcattgggaatgcacttggctgcagtttcagaacacctgactagctccgtcttgtgctctttttagacagcaccttgtctcatttgaacaagacatctggagcctggagatcccagggctgatatggcaacagtgcgatgccccccatggatatggggtcgttccatgtttcttccctgccttcctcagcatgttaacctttcagcttcacatccgcatcctcatggtcacaagatggctgacaagctccagctctcccatccctagaaaggtaaaagaatcagggttaaaaagctctgtcatgagattttgtcaatttttatttcaaagtgggcaaccgcccaacatacttctctttacacctcattagccagaacagattcacatggcaactcctgcaccagtcactggcaaaaggaaagggtgaaccatggtggttttaagccagattaatcctctgtgactgaagacaggctagcttctctgagattttgagatccccatctcttttcttgacacaaaattggggatctctgtgcagagaagaagcaggaggtgatggctgttttgtagaccaccaagaatgtcaatgactactatgactgctgtaattgtcgctagaagatcttactaaccctatggaaatttcacccccttatgatcagctctactgtaataaagtggatgatggtaggaccaggagcagtagaagacctggggtatagtcctggctctccccaggctgcaacacagacgatggcatttctagaatgtgctcttgatacagaaaggctggattcccagctaaaccttacccttaagcctggaatcatggccctaagtgaaaacagctgacctcctttttccccccaaatgttgccttttttacctgccccgcccctatcctgtgcccattaaagacttcagctggcaaagcaacgcaaatggctgagcgtcgaggatagaagtggctgaacagcgagcagagaagcaactgagcatcggaggttggagatagatgcagctaacttcagatactgtggttttagagaggggcctggccagagacggctgggttccagggacagaccaccttcccatcccctttccagcctccctttccactgagagctgctcgctgctcaataaagtcttctacattcatcacccttcaaacagttcatgtgacctggttcttcctggttcgtcggacaagaacccgggtgccaagagggcaagggctgtcaccctgaccctccactgagtcggttggtacttggccatccctggacagcagagctgaaagagcatgggttgtaacacgcttggactctactgcggggtctgcacagagtctgctcccgccagagaggagcagccggacggttccagcatgaagagtggccagcaataagctgagtaaaacaagctgctccagttcccgcctgcgaagggaagaggtagggactatcccatctcactatcccatcttgctctcacttataaaataggtagatggtgtgtaggccagaagaggcccaccttctcaggggcttgtggaaacataaggtgatgtttttgttgtcacaatagctgaaaggcactgctggcattccaggggacgggatcaaggacattaagtctcttgcaatgctttcaaatgccagtagcacctgctgatgctctctgacatttatttcagctcagaaagcctcccccattcctccttcctccccatccctccttcctctgtggtcccagcttacgccagtcatcgccagccacttgcccagctaggctcctgcggcagtcaaaaccccatcctcatgcctaggaacctgctgagacttaccagaggccaccaggaccgagaggagctgtgggtattctcaggcagatgaaggcaatgtcgcgccatatcccagcctgtgcccaccctctctgctgctggactcagctcctggcgcagcagtcactggggtgttcccagcatctgcctggactgttcaagggctgcagcacccagttccgagctagggctcataattcaggtctacagaggtggaaattcagtcctctgcctctccttgcttctttctgcttccaggacactgggcacattcttacttacgaactttcctccaaggtgtgatcatgtagaagttgatcatttattcatgagagcagatttttagacatgaaatttcaaaatcacatttaagacatattgcagataaggtctgccatttcctagtgtttgcagaggcggcaggatgatcttcaagtacctagctgggtgtggagggagggcgatgccccagtgcagaccagaactaggggattcagcatccaccagcattggagcaccgtgagcctcagttcctgaccagtgttctggctggtcatgactgtgctgtgtggatatttgaacattgtccctgcagacatctccgtgtatttcagggtgtacaggtgaaactgtgtactagtccccacccccagtgctttcacctggcattactcaaccctgcctgagatggtgagtgtgatctgggggagggggttgctgggcattttcaccttgtcccaccaggtccacccacccttcctccctcccgctctctgtcctgggaggctgatacatatgtaccacagcatggcccttgtggcctctggcttctgggtgtggctgctgggggctttgcaggcggctgcgggagggcagggagttgacatcacagactgtgcctgtggggtaaacatggcctggctatgtcccttgactagagaccccagctgcctcccaggccacgttctccacttgactctcctctcccagcctatatcacctaccccttccggggatcctttggacccaagcgagcaacagcccctacctctccaattcctggtcccaggcgcttgcactctccctcctgctgagccccttaccactcgctaagcaatccccatgggcacatgccctccacttccagctggagtcctggcacaaaggggagttcgataccgactgagactgagtgtccaccacagaggcaaatggggacctaaaatgaaaattcagttgagttacagaaaaactgaggagcggtgtttctaaccggcctgggcttttgggttggattcacgcccactgcagcagtgtggacattgtagacgctctgaagaccagcatccattcctttacttggagcacatctagtgggcaacctgacagcgccttgtcatctcctgggaagctttaaaaatgctgatgcctgggccccactgcagagagtgtggggtgcagcctggatgtgggatcaggggcccccaagtggtgctaaggagcatccagggctgagcccaccaagccaaacgctggggctctagaggcaaacacagcctgtcctgtgcttaaggaccccacattctgagaagggaggccaagaagttactcactgaaacataatgttaccagaaaggggtcccaatgccccaggagagggtccgtggacctcatgcaagaaagaatttggggccagtccatagaataaagcaaaagcaagtttattaagaaagtaaagaaataaaagaagggctactccataggcagagctgtgacatgggctgctgggctgagtatactcatagttatttcttgatcatctgttaaacaaggcggtgggttattcatgagttttctgggaaaggggtggagatttcctggaactgagggttcctcccctttttagactatatagggtaacttctggacattgccatggcatttgtaagctgtcatggtgctggtaggagtgtcttttagcatgctaatgcattataattagcgtataatgagcaatgaggacaaccagaggtcacttccatccccatcttggatttggcaggtttgggctggcttctttaccacatcctgttttatcagtgcaatctctgtgacctatgtcttgtgccaaccttctatcttatcctgtaactaagaatgcatacactcctaggaatgcagcccagtaggtctcagccttattttacccagcccctattcaagatggagttgctctggttcaagtgcctctgacaatcatggggcaggtgtccaagtggaagggcgctctgggggctctgagagccctgagaggcgctggccctgtgacatggagaatgggttgggcaacacttcttggaagtaacagcgtcaagccctgtaagccaggtgaaagagggaatggagaaaggcacttcagttaaagggggcaggaaaggcagagttccccaggggtgggtgagaactttctggagtgtccgtagactctgcttaaaatcctgctgggtcttcccagagtacttagaagaaaaaaaaattcccagccacagacagccatggcgtggccattgcccacctccagacctcctccccagccacagagctccaccatgcacagcttgtgtgtgttaaacacatccaagcctcagggcctttgcacctgctattctctctgcctagagtgcagtcccttcctgcacccccaccttactccagttaattttcaacattcagactgatctcggtgtcttccctcactgagggacatcaccccaccacctcaccactaaactcctccccaatctgttttttttaagttttgagacaaaatctcactctgtcacccaggctggagagcagtggtgcaatcttggctcactgtaacctacgcctcccaggtttaagcaattctaatgcctcagcctcctgagtagctgggactacaggtgcaccccatcatggctggctaattttcctccccaatctgaaagtgcctgcccaccacccccaccctgttaccgttggccacatctccttggttatgtccttcagagcatgaatgtctcataatgcaaatttacgcttctcaaaacaaaagagcatccagggagcatctccctaatccaaagggatgctttgtgaaggtgagttttgaactgtgtggccttgtcaggggcattctgagggcctgagaggtcttctgcagcaccccctgagggtctctggtcattgtgaggctgctctttactggacagcagatcgtatgatatgacaaagaggaattttgtttttttaacaatgtgcagtgacaggtttatctagtgagtaaaataaaggccatgttttgcacttgactttgtcattgttccaattcatggttgtttggctgccagtgaaagaaatctaaacaatggctaagacaatgagagtttcacttgtcttacaaaagggaaatctgcagtcagcatccagaggtggtatgtaggctccatgttgccaagaggaagatgggtgcctgctcttgttctactcagcctcgttatgggcatgttcctcatgagcataggtggctgctggtgcacatgcagctgactctggccccttcacttggcaacactcacttacgtctccttggtcacctgctttgacttcaaagatggcaaggctttttacaagcatgctactgaaaccacctttgcaaaaattgagacagtgagaaaattttgacagtgaagagatctgacctaaccaacctcattgtgcctttaacctccaaactgcccttggtcattcctgggtgtgggacgagctaactttgggagaaattcagtttgtagtttaaccttaaaaccaggatgataatagccctttctcaaaactaaatcatcaggttaggattatgagaggggcctgaatctgctgagatgtaagcatagttaaaggatacccacctttgttccagaggtcacaagattcataacttccccaattactcctgcagataacatgactattgtagaatctaagattgaccttttgagacgtcttttcagacttttgcatttctgaagaccggatgactctgcctggacccgagacttgtgacccactgggtcctgtggccccacccacaagcaaactcaacacaccaggaccatttcccacacccctatgattgcatccccaaccaatcagcagcacccattccctaaccctcttcccacaaactatccttgaaaatccctaagccctgaatttgcagggaggctgatgtgggtcataatacaactccagtctcagctggctctgcatgaattaaacattcgctattaccattctcctgtcttgataaatcagctctatctgggcagccagcaagatgagcctgtcgggtggttacactacttagatttaaatatcaacatattcagctaaaagagttgaaagcaattgcccgagtgtggaaaaaagggggggagggcaaagagagtgagaaaatgcttttttagtaagaaaccttatagaagtatttgctaatctgtttgtacatcccttggattaaataaatagaaaaaaaaaaaagattgaagtcatctgtgaagtggctctgcagccagtcttgtcccttcctcctaggggatgggcagcagctcagatccagggccctcttctccatcttcctccccctcctccctcctcatacacagtctgactgcagcttcccagctggagcagaaagcaaaagagaagtgattgtacctaatcacctaggtcattttctcagaaattgctttctttttcaccttttttcatgaggaacaaaaaggaacaggagaggcagcccaattgctgttcctgtgagctccggctctccgcagggggctggcctgaaagggcaaatgcctttggagcaggcttcaatcttctctccctctggagagaagcctgcctcaatgctactctacaaaatgaaatggccacttgtggggaggcaggcaagtccgggcaaaatgcttttcacataagcatgagagagaaagagagagcgagcaagagcgcgcacagctgctaacccgggtgagaagcccagatcaacttccattaactcctgtggctccaagtctttgaaagtgtgtccaagctggactcacatggtgatgccaaaagttgactctgaggactggagtttgagcccagcttgggtctaacttgctgtgcagtcagggaaaagtcatgtaacctctctggacgtcatttctgcatctgtcgaaggaggtggaaggatttctactctgaacgctgaaaggggcaataggaaaagaaaatgaaaccatcgtaatccccccatttgtaaattttgttaggggatatttgcaacattttcttgggctttatgtctcagacaaatgttccttatgttagctcttaaataaggctgatgtgctataatcgtttccttcttgtcagtggtgtacatgggagtgataactgtgtaactgagcatggtggctactgcttggggaaggagggacatgcacttggaggcaggtactccaagggtttggcagcacacacgcagagggcttcaaccctctcctcatgtctggaagctagaaacatggatattcatggtaatatttttcatgccttttgtatgtctacactggagtcatctacactggagtctaccaacctcagcactgttgacattttgggctggttgattctctgtggtggggctgtcctgggcattgtaggatgtttgtcggcatccctggcctctacccactagatgccagtagcaccctccccttctcaattgtgacaagccaaaaagatgtgtccagacattgccaaatgtcctctaagagtaaaattacccccagttgagaaccactagtctagaaaaaagaggacctatggctcggaaatattagatgacttctccaaagtcacagagtcagtaaatgaaagagatggctccagcaggcaggcttttcattgtcagctagtgctctttcaaacctctcagagtgccctcaagagcagatagctttattgttaggattacagtggagttgcatcagacgtaaatacaacggaatacacttgacagaaaataaaacgtgggaagattatctttagttttataacaaaaaggatagtaaatgtatgctaataatgaaacatagaatatgtaaatgtatgtaaataatccagccagggcatgcccctctttgggcacctgccggtgggagggggtggtggcagatggagctgcgattctgtcattgtgtctccgttgccaagggccactcaaatatgttcatttagccatattgaggatgatcctggggtatgaacatcttcagctgtttctacatctgatgttggccttgattagtaattttagatcccgagccaacatcaggtgctaccctaccgtttttcaaagagatggaggctgctgatgccatgtctccagagcagagcagggtggcaactggttggctggaacctgcgggcccatcatgggtaagaggaaatgaaaattctggaaaggtgaataaattgtaagcaagcacctcacggcttacataacgtaattgaaatttccagaagcagatggatgatgccctagatccaaaggcacagtaactagatggttttatgacaagggcagctcatcaaatgtcagggacgttctgatgcagaattgcagatgtcagggctagcggggcagttggacgatggggactctaacacctcttccaactcattgcttttcattaagttattagatatgaaaaaaaatacttctagtccagactgtcatttgacctttcagtgggcccctgactacgtctctgactacgtttttaaactgatggtcagcaaatgcatcccaggtatgcgtcctgggaggaaacagtgggtaatctgtgccacactgcatttaactcaccaacaaattccacctcacattgagggggatgatgagatgcagagatgggcttgacacagggcaggaattcagctagtctttgggctccttagagggaggccttgggcactgaatgccatgatgtctaaaagcccagaaagcttggaaaacctatagaaagaatgtgagaatgattcgaacggccttcccaggcataaaacaggggggagatactgctcattcaagtggcccctgcaagcttcctcagtgtccttgaggaatcattggctaaagagccttggctacccagtggttaggaggatctatggttatgggctggagccaggctgcctgggagttagatgcagcaacctcacatggtgctgtgcaacactgagcaggttaattaatctctctggttttgtttgtttgttttgtttgtgtgtgtgtgtgtgtgtgtgtgtatacaaaatggaattatcatgaagataaatattaagttcagctatatgaaattgctattccccacaggaaattgtcaaccataggcaatttcatatgattcaacctaatattccatagggaatgaagttaacagttgaaaagttctgaccaaagtgcctagcactgaataagccccaggtaaatgttagtatcttacttacaaaagtttagggaaatgtacagcatcttctctatgtgtttgtgtggtgtgcttcacactagtgatcttcaaactctatcacaacctatctctattagtcagggttccctaaagggacagaactattaggatatatgtatgtatgaaggggagtttatcgggagaattgattcacaagagcgcaaggtgaagtcccacaataggccatctgcaagctgagggacaaggaagccagtctgagtcccaaaagctcaaaagtaggggagccaacagtgcagccttcagtctgtggcccgagagtccctggcaaaccactggtataagttcaagagtccaaaagctgaagaacttggagtctgatgttcgagggcaggaagcatctagcacagcagaaaggtggaggccagaacactctgccagtctactccttccatgctcctctgcctgcttttattctagccgtgctggcagctgattagatggtgcccacccagattgagggtgggtctgcctctcccagtccactgcctcaaatgttaatctcctttggcaacatcctcacagacacacccaggaacaatattttgcatccttcaatccaatcgagttaacacttattaaccatcacaccatcagagggttgtgagctgttaataggttaagaaacaaaatcagtgggtcagaatttttcccaacaggacggaataggggagaagacaataggatattttacacatcataaaataaatattgctttaagaggcttgtcaattccatcacgtgtgtgtgtctgtccacatgtgcgtgtgtctatgcacgagtgtgtaccggatcacagtgaaagatacatttcatgctacgcattagagttgaataaagttttaaagtcagctcactcgaccatatatactggaccttatgagtacttaagggaatttttaagagtaattttgactgtgccactcactaatctgtggtcttgagcaagttactgggcctctctgtgtctcagtttcttcatctagaaagcagtgaagacccttgcacctgcctcccaggactgaggtgagaaaagcaggtaagaggcttggcgtatttcctggcatgtaatgaagagcccagaaggtgctagctgctgctgttttgcttgttctttaatttccatggcacgaatgacattgcagaaggtgaggctctactgctaaaggaagaaattgatttatccctgatttgggggaaagctcacaaggcagaacattcttcgataaaataacctaagaatatcaaacagcaaacaattacccacatgtaaacaattacactgcactaagtaactctgttatagaaagatggcatcactgtagggagagatcaatccaagaggacttcctggaggaggaagttctcagctgatctcaaaaaagattcaggggtgggattggaggaaggctgggtcaaggacatctggggagaaaaaaggattgtggaaagttcaagatgtgatcggtaaatcatgcacaaatgccaggatcaagagctggacccacctcctggagagggaccacggtcagacaatgctctctggggttcacaggcaagggacaaatcagacatcacgagagctcactgttgatggcatattatgatcatgtcagggccgggcatctgcctaagtactacaaatgtttatgaatattaataagcattttgttcccaaaggaccacaaatcagttaattagggccctgtcaacctgtttatattatctataaatgaaaacccgtcagcaaccaaacatgaaattaagtgagccgtgtgtgggctgccaccatctctggataaacaacactgccagttcccgtgtgagccccaccctcggtacaaaggaggatattctcctcaccactctcattttaatcaaggcagtggttacaggaggcccatgatagagggtgcctcaggtttcaccactgcatgtggggggatgatttaagactgtcggtaaattagctgcaatccagagtcttggaggagaagaagaattacctataaatcaatgttccatggacaggtaatcaggcccccattccaagccctgattacgctggacccagcagtccatctgtctcgtcttcctggggtgatggggctgggatgggggcactgagtcattggccccacctggatcatgtttgcgtctggacaggtcagtgtccctgagcccaggtgtcttaagtgtgtttcctggaacaatcctcaagaaatcacagggccctagaggcagaagcagagagagagagagagatggagagagcggcagggactgagaaagagatagattcattcaaaaacagtgtgtgctgagcactgggctcgcagcccaagatagacacgtcagtgagcaacggaacagacaagagaggtggcaggcgacagaggagccaaggaccccgcagaccagagcatgccctgaactgatcaaggcgagatgccctgtcctccacctcatgacacgggtgactccttccgaaaaatttccttcccaaaaactccttctggggcaaatccttgttaatattttttcctctatgcaaaaaactatggtttattgaccatttttatgctaaaacaacactaaattccaacaagttgcattaaaatgggcacaatggcttgaagaattagaattaatgatcaaaattcaacctaacaagagccatccctgcggtagagaactggggtagaaaacacagatcctggagccatctccctggtttgaatccaggctctgccatttgctggctgtgtgaccttgggtaagctacttacacggtttgtgcctcagtttcctcatctgtaatatgaggataataacaggattgaccatgtggcaggattgaaggagttaatatatgtgaagtgaacatatcagctgtctaataattgcctgcttgaggggaagtaagtaaagatgtttagggcctgcagcctagttgtagcacaaaccagctgtgcaaccttgagatattacttaacctctctgttgtctcatactctctatttccccttcctgtgggagtaaagtggatctacttagccaggtttgctcatgaggatgggaaccatgcatctatgttgtaggtttgcttacttggttcttgtcgccgtcccaccaaaaggtaagctctggggtagggacgtggtgtgaccaactgttccctgctgcctgcagggtccccaggcccagcttcacaggcttgtgacctgtgcagcctcccatgctcagaagagcccccgacttggcttagtgctctattgtcaccatcttaaaattcttaaatgtctttgaacatgaaaccctgtatttccattttgcactgggcctgcatagcagggatctgatccaacccacacacatgtactaggtgtgattctggtggcaggaagcctctttcatctcttcctaaacatgtgagcatcattttctcccttgagctcgctgctgctctgtgcctttctgtggggaaaggggaacacccccccaaccctggaactccaggtccctgccctgctttccctaaaaagggtccctctgtccctcacagatgtgctgggaggtgtaagcacattttcccagttgagaagtgatccagagtcaccccgacatcgtgcccagcactgagctgggtcaggctggagagaaatggtgttggccacagaatctgccatcccattgctattagtgtcctgtggctgctgtgacaaatcactgcaaacttcggggcttacaacaataggaatttattctctcacagttctgaagacaggagtctgaaatcgcggagtctgcagggcctcgcttcatccagtgtctctcagggagatgccttcacagcctctctcagctttgggcagccccaggtgttctcggcttgtggtggcctcagttgagtcccatccttcattttcacaggtcttcccctctgtgtctgtgtctccctcttctgtctcataaaagcacttgtcatggttgtaggacctacccgattaatccaggatagtctccctcaagagtcttcacttcattatgtctgcaaagactcattttctaaataaggtcccattcacaggcaccagaggtggaggccttggtcatatcttcttgggggccacagttccatgcactccatatccaagatggggcagagaatgccatgagggcaaaggaaggcaggagcatgacagtagcagcttatccgagcacagctcttctgcgtgccgggagaggttcccgttgccttgcatgttcgttaactcatttgctttgcatatcaaccgatgctatgactgtacccattttacagataaggaaactgatgcacatgcaaaaccaagtcattgcttcaagacatccagcgaggacaggtcagagctggcagtggaagccagtaagtcttccgtctatagagtctgagctccaacccacctgcaccactgtgggctagggtctcagatgtaggtggcctggggccaggcaggtgacataaagagtgaaggggcctccagaaagtggccagggctcgggtgaactggagagggaggtgggatgtcgttcctcagcaccacccaaatgcagcggtttcaactctccctattttccaaaaagggagtaaaatccaggcttttatgtggaaattcccaacgatcagatttggtgattgatatattttttaaaagcaaaatgaaactcatcagtagtctgtaaatcagcagtcagctaccacctccacggtaaaggagagggtcattaattctgactttgggagtcaagaacacaagaatggccagcgctgatttaggggacgcaaggcccttccgtgggcacagccgtgcttggcagagccgcgggcgcttgtggctccctgcgatcgctgactcttaagtcctgctctcatctggccctaaagaagccatcagcaggaggtgacagcgaccgtaattctgtttttatgattactgagcaacggtcatttcaggctgagtggtgctgagtgatgggtggtgatttaggcgccttacagagggattagggaggtaaagctaaatgcattttcctccgaggcccagactggctgcaaacaagtttccatggaggatgctgataaaaagcaaattattttattctgttcacaatcaattccaactccagactgcagacttccccaagaaataaagcattaacacttatcgtatggagctgaattctttgaggaatagtaattcttaaacagacagaggcaacatagttttaaaccattaaaatccagcgtgtgcacttgctcatccttcttcttaatgagccttgcgccgtctccatgtatttggtgtaagaaatgaattcaaatcacatttcattgacagggaaaggggtgcccttgggggcatttgtactagaaatagacatttttgcaatggggttgtcggcttgtgtggtggacgctgggtctttctgattgttcagcagccattcccccattctctggccccaggtgttcttggctcacaaactcaatccctgtgctttgggtggatccagggttggccacgtgacccagacctggcccttccattgtccagcctcagtcactggtaggggtggggatggggctgaagatgcaaccctggttggtctagtcagagccgatcccggatcgctgctggcacaacagggactgaggcctctcctgatctcacagtcactgtgagggcaggatagcggcctgaggttgctgctcatcatgtctttcattcctgccagctgagaatggggccaacctagagaacagaggaactgagagacagagagaaatggatcagtgtttccagagtccagaatccaagtcacttaaaccctggatccagctgcatctgaggccataaacccttcgagctttcatttacagaagtgatcatactcctttttactttagtccatctgatttgggtttctgtcactcacttgcaaccaaaaaagtcctggcacacacctccttgtaagacaccatcttttccagagcactggtctagcccatgattttccccaaaggtgacagcacagagacaattcttctctctctgctcagtcagacatacactggcctggggtcctctggtcattttccttgcttctcttaaggccctgttccaaacatgcaaatcacggatccttccatggttaatctctcctgggcagaggttgagggaaggtagaggtcaccggcacatagttcatttgcaaatatatgctgatgacatctatcttccctcaaccaatgcaccctcaggttgggccctggctatctaacactgcaaaaagccttcacctgcctagagtgattccggaaacaccaagaagcatgccctccctgtttccccaaatccttcccacaccatcgctgctgcctggaatgccagcattagggagtctcgttttgaatttccagatgaagaaaatcatcctggagaaaagcaacactttaaacctcacattaaagcttcttcaatgagaatatgagaatccgttttccacgagcaattgttgataagagaaaggtagaatttgtggcacggtccaatcttagtctcagcatttacgatattttgggagcatgaaaatctctggagatgtgacctagtggagtagaaagataacgggaggcctggtttctaatcctgctggagattcatttacccagcaaatacttactgaacattattacgtgacaaactctgtgcaaagcaccagaacgttgtgagttgtatgactttgggcgttttctgagttgcaggggtgaggccagaaacagtgaagatgaggacatttggacactttcccttcctgcaccatggcatgcattactaaatgatcaggacactccatcctgctgggggcttgagcatgttcttagcgggtaccaggtggctgcatcagtcagaatgggctagattatgctgtgtaagaaacacataagctgtttcatggctcacaagagcaaaggtgactttttcacggggctgcaggtcctccacagccggactgccactcagctccaagccacctgccatccagaactccaagctctatcacagggtttcccaacctcagcactactggcattctctatcgtgggggctgttctgtgcagagaaggatgtttagcagcatctgtggcctccaccgatgtcatgggttgaattgtgccccccaacccttttcatatgttaaagtcctaagcccagatacttcagaatgtggccttatttggaaatggggttgctgcagatgtaattagctaagatgaagtcacactggagtagggtggggctgtaatccaaagtgactagcgtccctagaaaagggggaaaattggatgcagacatgcgcacagagagaacgccatgtgaagacgaaggcagagatgagggtgatgcttctatgagctaagaaacaccaaaggtggccagtgacacaccagaaactagaggagaggcacagaacagattctcctcacagtcctcagaagaaccgaccccaccgacaccttgatctgggactccagaactgtgagcctgttgtttctgttgttgaagctgcccagtctgtggtaccatgttactgcagccctagcaaacaaattcaactgcagggtgcccgtagcacccttcctccaagtcatggcacccaaaaatgtctccagacattgtgaacggtcccttgggtgtcagaatcctcctgggctgaggagcacgctctaccaggagcatttccagggactggtggagcaggcacaggtggagcttcagctcagaagtagctcatgtcacttccactcattccattggctgaagcaagtcacgaaggcatgcctgagtccacagggtggggtttacggccttcccatggagcggggcattgtacggtgaacagtcacccattttccccaaaatcaccacctaaggggaagaagtggcaggtgagcccgtggtctcaacctcccctccactgggcctttgctcacttgcctccttctcaagggggcttgctggggctgcgccctctcccaccctcttgtctcccttccctgctgtacattcccctggttcttgcctctgtccagcacatggattcccttcggatgcattctgagtgtcctctggctcccctcccacgtgccagccccacgaggacaggccctcggtgttacagctcagcccctagcacgtctcctgcccggcgcagatgctccatggatgttggttgagagagtgagtgaatccatgagcgaataaaactttcaggactaggtgatctccaagaacacgctggaattctcccattccagcaggaattggaggctgttctttcctgtccctaagcctacccatcccatggtctcacttcctgccagaataacagatcctgtccttatgccaagggagtaaacctccgtcccttcctcgtagttggccagtttagctcctagtcagtaacccgcaggagcagggtgtttggtaaccaggagctaccaactgtaatgaggacacctgcagaagccagggcctctgctggttgctatggaaaccctgcaaagggaaagtcagcctttcctcatcagagctatgtggaggcagatgcatgttggtgatctcattagcccttccaaccagtggcccctggaagtttcctgcttgcaccctctcttgcccatccactctctccctgagctctggagatgagagcaagtgttgtcctggggtccttggccttgtggggttttacagtctatgcaatataatctacaagcatttattgagcatcttttatgtgcttgggcccaagtgcagcctttttcccccaaagagaagacattgaaaaacccacagcagtgtggccaagcacacgttctggagcccgaccgtctggttcaagtctcagccctgccattctcttgctatgtgtggtgcctttaaaatacttctacaagttctttgacagtccttccgctagaaatatttttgtttctctgctgttgactaggaatgagtcgtcctcacggacagcatgtaggggaagtggaaactgcaaattcccaaggtttggtcacaaaaggcagttcagatctcgcccctttctctccctctctctctctcgacttgtttcttaggagctctggcccaaggtgtcagaactttgatgaccctgaagctaggctggagatgtcatgacaacagattgcgcggagacagacagagatggtgggggagccctagctcctggcctcagcatcgctgtgggtatgaggctcagaggggtagacacgctccaagaccaccaggcaatgccttatctgcaggcatcccagaatgtgaacttgagcctcctccagctaacacagactccctgctcccatggtgtgggagggaggaggcagagcccagaggggagacaatctggttgtgcagagaggaacactgagggctgtgttctgagtggcaaggagcaagggactcgcaggggcaaggctgggggcaaggccagccacaggcagaagtcggggctgagcacaatttgcacagctctagcaagttctaacttctcctcctatagtttcttctatagctcccgagacactgctccttgtgagtggtggtaccaagaaagggacagaagcaagacacaggcagagaaagatagagacacagagagacagggaagtgcccaaaggaagacagactgaagcagaaagaaaaagaaagagcaagagaaagtgagagagagatcaaggggaagacagagagagaaacggaggctggatggattccaagagctacagaaagtcggggtcgggtggcgggggcattaggctccaggtattgagaaccccaagtctgatcccatggaagtcactgcttctgcctcctgggaaaaggctggcagctgttcttgctggtcacctacccctgcattcctggtcccaccacccccagacacataggagctccgtgtgctacaacaggcctttgtttccctgagggtccattctgcgcccagccccatctctgccctgactcccaagctgcccacctcctggcgtgaacagatgcccccctcttcttgttttccctgtggacagaggggacccagcctgggcttctccaggcccgggcattgtggattcagggcagacgccctccctgggaagtcagagggaacagatgtgcttctgtggtctccatggagacctgccagccgggcaacctcaatgggcagccgggcctcgaagcttttgtctttgcaaagcctttcgctgaatgcaaacactaaaagcaaatctgccaggcatccagagagactggggcttccctcctggcctcttggggcctggccaactaggacaccccaaagcaggaacagatgcatggcggcccttggtgaactctcagaggaccccaggcacaggctctggttaaataatgctcggctccacctgctgttgttaaaacatgccaatgcccactccagttatagtacgatggccccacaagtctgccctggaagaaagaaaagaacaaccctggcctgtcttgaatggatatcaaaaagcatgttcaacaggtggaggcagatgactagaatatttcacggccaattgtttattcattcggcaatggactagggtataggcagtgagcaccccagacacagactgtcctctcatggagctgatatgaagtagaggagatggacactcaacacggtgacaactaaataagaagtttccagccaaggaaacaagagcagatcgagggctagagagtaatgagagtgggtggggcctatgtcatggggcacacagggaaagtggttccaagcaggtgacatgacagcagagacctgaatgtgatgaggaagagtggcctaggaggagggctcagagtccagtgtaaaggctcagagtccaccttattcagaagctaaggcactcactaatcagaattattcccacccactcaggatgcttcctggcttcatgaagatggaggcacagcctctgccccaggaagaccttgtaagatcttcttcctcttccagagggcagggtcaggtagggggtgcagagagctccagggggctcccctttcaggttaacctgcatgtgaggctgatgttcaggtgctgtgggaccttaaaaccacagagctggaaggttcctctggggtcacataactgcccagtgggttctccttgcgtgctgcccagacagagccaatttatcaagagaggagaattacaacagagaaagagtttaattcacacagtgctggctgaaggggagagcagagttttattactcaaatcagtctctctgaaaattcagaggccagggtttttcaagcacagtttgttaagcaggaggctagggaatgggtgctgctgattggttggggatgcaatcatcggggtgtggaaaacagtccttgtactctgaattcacctctgggtggggccacaaggaccgagttaaaagtcacaggtccaggtagagtcatccaggtggttttcaggaatgcagaagtctgagaagacacctcaaaaggccactcctaggttctacaatcatcctgttatctgcaggagtcactggggaagttgcaaatcttgtggcctccagaataatgattggtaaaatcctttttgcctggtagaatttgggctcctctcatccttctaacccagtggtctttcattaggaggtttagtttgtgggaagggatattaccatttaaactatacactaaatttctcccaaggttagcttgccaagcacaagaatgaccaagggcagttggaggctgaaggcaagataggggttggttaggtcagatgtctttcacggccataattttctgttataatttttgcaaaggaggaattgtcagaggtgaaccaggagattccatcttgaataggggctggaaaaaatgaggctgagacctgctgggctgcattcccaggaggttaggcattcttagtcacaggatgaggtaggaggtcagcacaagatacaggtcacaaagaccccgctgataaaacaggatgtggtaaagaagcccaccaaaacccaccaaaaccaagacagtgaccaaagtgatctctggtcatcctcaatgctcattatacaccaattataatgcatcagcatgctaaaagacacttccactagtgccaggacagtttacaaatgccatgacaacatcaagaagttaccctctatggtctacaatggggaggtaccctcagttccaggaattgcctgcccctttcctggaaaactcatgaataatccaccccatgtttagcatatggtcaagaaataactataagtatactcggtcaagcagcccatgctgctgctctgcctatggagtagccattcttttattcctttactttcttaatagacttgctttcactttactctatggacttgccccaaattctttcttgcatgaggtccaagaaccttctcttggggtctggatcaggacccctttctggtaatgtttccagtcactcaggccagcatttcccaaacaccagcattcatgtccaccagcaccgtcttgtacctgcatctcacctgggcaaaattacctatgtcctttcaaacctgctttccatcaactctcttgtaagaatcaacctcatacttgggaatagcaattatcacattatttcttgttctttctatttcttgataaatagttattaaaatagaaacatgcatgtccaggtaccacctgaaatctgcccactgatgccactttggcagcactgttcttgtccagcctctgagtttatgcacagctgaggcccagagacatgagaggatttgtacaaaaccgcaggattagcaaactctcttcatttccaactccctgtctgtcctctgggctggctcattcccagccgacattcagaaaacaggcccagtgacccaggtcacccagttctcagaggatgccaggtctcagtgctctttgatttctttctgaataagctgtctctttcctcctcaatctctcccttccatctctccttccctccctcctttcctccttccttctccctccctctccactctccatagttctgaagtcaccaagaagattgtggaaacttaactcttcctaactcactgattccaagccactctttccagagaaaacaccatttatttcaccctcttctccataaaggggcaaaaagatccttattcctcatgaacattttgaaacaacctatcacatcaaatatgggtcaaatcacccccaacagaatccttcagggaggattaatggatacatttattgactcaacaatttttattgttatttattttgctacttttaaaatatgacatttattggttaggtggtttgatacagaagagctttcttttcattctgcttttgaaagttctatacaactgaatacaaagaggaacaagaagtaccaaaatcaaacttattattccctgtccatgtggcattgaccagttttgtatataacagatagcgacagtttttaagtttcctttagaaaaatacgaattctacacatttgctattgtttcctgtctaatgcatgggctgacatcactgggatcagcttccttcttgaagaaaaaaaggagatgaaagagaccaacatagggtcagaacgcatggcgaatctttctgaagctggcatctgactgtcacgtagcttccccagagctgctggaaaacagccctctgggtttttgtttttgtggggttttttttttcacagccaggtatttcatgtagtgattgaatctcagcatttcaacaaatatttattaagaactcaaatgtgagtcagaccctgttcaaatcactggaagcaaagcaacgagcaaaagaaaaatcctgccctggtggagcttatattctgcttggggaaaacaggtaatgaaccaacaaacaaaggtaccattgaaacaaaaatgaatgaatgaatcattagtcttcatgcaaattcctttccatccgtcaaaacctggcttaactctgctttctcctggcagccctcccagctccagaacatctggacgctctgtcctctgcctcccatggcacatgacacacgacatgtggccctgcagagagccactagcagctcaggggatgttcaatgaatgaaaacagatgaatgagcatgtgcttatgtgcagaaaacaactgcggatgtgcttgtgtttacgtgcattggatgacaggtgtgtgtgtgtttgtgcacacgtgctaatggaggaggctaggtatgtgggtgtgtgcttgggtgcagtgaattgtgttttgtgggttggaatgaggttgtattcagcacgagcaaagatatacagtacctgagcaggaggttttgtggttcacaagagtgtgtgcatttaacatatatgtacaagtaggtgtgagtgtgtgctttataagtgcatgtgtatgtgtgtaacagagggtgtgggagtgtgtgtgtgtttgcaagtgcatgtatatgagtgtgggtaagagagtaagtatatttgtgtgtgtgtttgctagcgtgtgtatgtgtctaagactgagtgtatttgtagtgtgtgtttgcaagttcgtgtgtgtgagtgtgtgtgtttgcatgtgtgtggtaggcacagacacacgcctaacagttcctgcctgactggcaggtgtggattacagaccacactgactttgtggcgatccagaaatgcagagcagggatggatttctgcccaggattcaggaagagggaagaggagaatggtagcggggccaggcgcggtggctcacgcctgtaatcccagcactttgggaggctgaggggggtggatcacctgagatcaggagttcaagaccagcctggccagtgtggtgaaaccccgtctctactaaaaatacaaaaattagctgggcatggtggcgcgcctgtaatcccagctactcgggatgctgaggccagagaattgcttgaactttggaggcggaggttccagtgagccgagattgcaccattgcactccagcctgggcaacaaaagtgaaactccatctcaaaaaacaaacaaacaaacaaacaaacaaacaaacaaacaaaacaaaaaacaaaaacggaagcagatagagatgcccaggagcttgcattccgtcttctgggtcccctgtaccatcaagaaaggaagccaagggtcaggcctacatgtgatcacctgtctatgccaagggtgcacccaaggctgccaggcttggttgcttccatgttccctctaaacccccttctctgtgaagacagagactgtgaagcaactgcctttgaagaggccatgcctgtctgagctgagctcctccataagaggtggtctcagtgtaggaagaaccatcagaccactgggcccaccctgactccactgctatgagctccatggtgctggataaatggctccgctcctctgctgcctcatccacatcacagacataaaaaacccatctggctcagggggcggaggaataaagaaagattggttcccacacagcacataaccaatgccctgaacaaacgccattctcggtgtcattgcctgttcctatcatggggcaaagcttccacacaggacccaggccagcagacaccagaactgctccccctcggtcacccatcctcatggctcctgcctgcctgcttaggggctgtccctggggttccccagggctgtcccatgctcctcccaggcctcctgaccatgtccttggtcaggtctctattcccctacccctgcccccactgagggctgactttggcctcttcttggagatcccagaggactacccagggaccacctatttcccccacccaacctggacagcctgcctggctgtgctcctgtgcctttctcctctccctttaccctcctgctcatccagcaggagcaaagctccacatgctgtcttctgactcctcttcccctatcactgcacgcaggagacctggccacactgaagtggccccactttcctgccccctcactcactcccaaacaaacccccactccctccagagagaaggcaggtggaggaagcaagagtcgagagctgggtctgcacagctgagttcccctcgggaccctcccaagtgccccagagggtcctggcttgctcagctccacatgccacccactagccacgctgggcagcttacctttccagctacccggaacccagggctccaaatctccgagatggcttctcagccagaaaagtcctcctgttgacttcttcgttcccctcgctgttccagggaaggtcaggctatgtggatttattctccattaaatgatacatgctgatctatgcaccctcactatagccagagccgctcccacagtgcagagctgtcagcgtggctgggtggtcagggccacagccccaggctgggaagactcagcccatctcttgaggtccacctgggtcccagccacagctgaatggagcttctgactcctgtgcccttggaggtgtggaatgggacttaaccagagaggcctgatgccgccgactccccacagcaaggacaccagatgccttccaggaagccacaggccctgccacctccaactccatcctcaggtcctctgcagatatctgccacagaattcagcccacggagaccaggaactccaagggcagtcgatcaggcctgactgtgccagggagcccaaccccatccaccccctgatgacaaaatcttcaactgctcaagatgcctgcaccgaggagcaacatggggtcagcatccactgggaaaccatcactcatgctgggggcggcctgagagcagagcccggcccatagtaaattctcagcaaatactgcttatttttaatatcctcccaaaaatgcaaccaccaactgatggtttgccaaacttcagtcatttacaccttagcttcctgtttttttgttttttgtttgtttgtttgtttgtttttgagacagggtctctctgtcacctaggctggagtacagtgactcgatcgtggctcaccgcagcctcaatctccccaggctcagactcctgagtagctgggactacaggcgtgagccaccatggctggctaatttttgtgttttttttgtagagacagggtatcatcatgttgcccaggctggtctcaaactcttgggctcaagcgatccgcctgcctcggcctcccaaagtcctgggattacagacatgagccactgcacccggccagcttcctggttgtcatgatagcaacacctgtctctagtttttcctagatttttcaaaatggatacatattctacttaagcacagctatttattacagaaatcacacgctctctctctctcttcgtattttgacgtttaaaaccagtgccataaatagaagataataataaaaggaaatacagtgtgagtagtatcacagtggcttccaggctctgagcctgaggcctgctccatccgcagaaggatgagcaagcgatagcgaagcattcaaggcaggctttcgatgggcggagactctggccaggggaaaacagagggatcaaaagagatttgcacctgcgagtccatgtcattgcgtgtgacacgtcagcctgctaccaaaacaccttgcgtttgtctgaaagcccccccacctttctgtgtggctcacacgtcctgcactgtgggaaatacggagtccaccaagcagccaggcaccatggctggaagatcagatctgtgccaggtcagcccatgcgctcccatctggctcaagtcagtttctttacctgtgaaatgggaggagatattagactgatttccctaaggtccctgcagctctgatctgctgagaagtctaacacaacacatccctgtgattttccaggatgtttaagaacatcaggagaccatcagttaagacaatctggggtcatcacccagtcagccctggttgctttattgagcaccacctgtgtccggagcacggcatagcataaatgaggtaggttagatgatgtggtcacagtctcccttaaaggagacttaaaggagaccttaaagtctccctcgaaggagagcgaacttgctaaatatatggagagaacgcactgcccaattgtgcacaaactacatcctgggcttgtggttagaatatcctgcagccaggaggtagaggagcagaaaggaaaatccccaaattcatgcaagtgcagaaacttgtgattaatgtccttgggttgacctgtgcttattataacagtaaaaaacacctcagtggagatttacaatgctaatgagacatgtatgtacaaccatgcacagccgcagcctatgcactgccagaaaaccacccagaacatgctcagcagcagagccccttcctggcccttcatgaattctcatggaagacccccaaatctgcagcgtccgtcggtgcagcctcacccttgctcagcctgctctgatcagctggcagagcacacttccgttttgcaatccactcccttgcttgcttttactttggacttgctctcaaattcttttgtgtggcggagtcaagaacctgaacctgcccacaggcaacataaagagacaaaaggcaggtcctccctcccgtgaaggaggcagctggcaacaggaggcactttctgggatatcaacaaggcctctgtgtcacagggatgcccactcctgcccacccatgccgggaggaccctatgatggctgaactctcactgaaggcgggggcttgatggccaacaccccagcaaacaagcttcatttgtttaacacgttcagtatctgtctttccacttgctgccaccccagctcccctacacaagcacacacacgtgcacacacacacgcacactcacacactcacacccacccactctctcacgcacacacacgcactcacacccattcactcactcacaggcacacaccctcacacaccctcacacgcacactcacactctcacacccacctgcccactctttcacacacactatcatacacactcacactcacacccactcatacactcacagacacacacactctcacacacacatgctctcacacacacacacacaagctccacgagggcagggctttgctcattgtagtaattatggcatccccattgcttgaccaataaccactggactcattcatcccacaaatagttattgcacacctgccgtgtgccaggggccaggcgtatagagttgaaagaggcaagtacagcccttcttcacgtgaagtctgcattgtggttatggggtcagttaagccaagaagccaataaacacataattccaggcaattatagatgctgtggaaaaaagaatgcagggcaggagatggagcgagagagtggggctgctgttgacagtggtcagggatggtttctcggaggaggtgcctgtgagtagagccctgcgtgtgatgacagccagctcggaagggcaaatcattccagcccggcccggcattccacagcctcctcccagccctcatgtgtctccccggtcctcatcaccacctggtattccctgtacatttctttcttgtcagtctccctgagtgtaatttaaattccataagggaagggataatgctcaccgtgcatacttggagcctagaacagtgcctgacacgtagtagggtctccacgcatgtttgttgaatgaaagactatcacattgccttgtgattgtttacattacaatacgattaaaacattagtttgtgactcatctctttttcttctttctgatagcccctgtggacttctcagccgaaaaagaatggcaaggtgaccttctgtcctttgggaagcaaaccaggcctgggggctctgagttctgagcccctttctgtccaggtttcaaggctgacacctcgtgaccatcaagtaatgatggtagccgggtgccatgggagggaatgaaggctggctgggggttacagagaggaaggagttacagagaggaaggagtgggtcctgcaggttggttcctgaagatgggcaggaagggtggggtttggggactcgaggcgcatgggaggaagggcctttggggggatggctctgggtgggtttgcgggaagccagactgagtacacagagggaggaatgtttctgccgcccagcgccgcagcagaacttggccttgacagttgcctggagggtgggaggaagagttggaagggttctgatagcagcaactgttatcgttcccaccgttattaggctggctggtgcgtatcgagggcttactatgccagcagtgttctcagcggttcccacatattgagagattcaatcatcacaacagttctatgaacagggactattattccccttttacagatgaagaaacggaggcaaagaatgaggcagtaactttcccaaagccacacagctgctaagtgacagagccagggttcagctcaggtggtctggctccagggacacagctcagccagcctcacctgaggacgaggggccctttttctcgggctgggtgagccccctccccatccacccgaaatcatgaaatccccaaaataatgaagattcaattttaaaatgaggagttgacacatctcaggggaacaagtccccatttgagcatttctacctcccttcccacaaaggtgtagagattgtacctgctcctaccatgacgatgacaatatgtaagcaaacctctaaccgtgaaacacaagtcctgggcatcccgctgggcagggtctttggtcctccacggggacaggtcctgtgagagggtggcattctcctgggtgggaacatcctctgtaaatgcaactcccagagtatccccccggccactgactgtgccttgactctgggatgggaagatcatctttccagagacagggaaagaagcagtggttcggaggcagtcagggttccagtcccagctctgccagtaagtagctgtgtgaccttgggcaagttgcttggcctctctgtgcctcggtgtcttcctctgtaaaatgggcatgaaggtaatggcccctcccacagagagggcttggggatgagcttggtcagcacgcataatggagcagtactgggcacagggtaggcgccctgcaaagtcagatgttctatttgtttgtttcaggcttctaatcctatcccagccagagcctgggaagaaggagatgaaaccaaaccaaaaagaatgttttggttgccaaccataaacagaaatgctcctctaaagcagcactgaccacccgtggttctctctgcagggtcagggagctgagttcttttccacaggacaaccacccaggtcataaacaagccacaaagaccaaaacctggtcttaacctcagaccgggaagaagaagagcaaatcactaagcaaacgaaattaaacgcccaaacactgcaagtacaaacaaaccgcacttccctctgtggagtgagatcagggctcatcactggacattgaaaataaaacaattctgttttctcattttaagggtggatggagagaggctgggggcttgagggacgtctttgggagcagatttcagtgggcagctgcaggaacatagctttccctgggaaaactttccagagtaagttttccttgctttgaactttcatttacaaagtgaacaaaaaaatcacgttcaagaactgaggctagacagctggctctggagcacagaacccttggaaaacgggagaaccaacctcccttccttcgccttccctcagcagccgctctgctggggttgcttggcacaggccagggacaagcttgccgttatggagaaagttttagtctcaagcgtgagcgtgtggtcacacggataagtcattagagggaaatcagggatgaaggttgaagaggaaggccaccactctctgttggtggaacggttattttgtgaaatggaacccgtgttcagaaaagtgcataatacgtatttgttattattagcagattattgtaaattgaacattcaggtaccccttccactacatcatgatacagatagatactctggaagccttctatgtctccctgtccaatcacagtctcctttgctgcttaaaagtcatcattcttctgacttgaggcactagcctccttgttctcctctgtttttacactgcctaagcctgatcccctgaacacacagaagcttagttctgcctgattttggacttttgtgtctggtttcttttgctcagtggcatgttggatgcagcctcattcttccttgcactgctgatgttttgctttggggtgagtccaccatgaggtgcttatccattctgctgctgatggctgccggagtcatcagcagggcacagggactgttccccatgccgcttcggtggacgacttggacatgtgtcccaccgcacatgtaaaatgcatttctgctggggatataccaagtgtgcaattgctagggccagagggtcttcacatcttcatctccagtagacaatgccaaactttccaaagggttggcgtcagtgtctatggcccccagcatcatgcgtggtagctccgtgttcttgctggcacttggtactgtgggaacgtcacactcctgcttggttgcctgcccctggccagaggctggccctttatcggaggaggccagtgcacagcaagagcctccaaagcagagtggggaccattcacacctggacatgactcctatctgtcctgcaggcaatgactccagatggcaaagggaaacagaccctggagctcatgtcccagctgcccctcttggcagctctgttatttcaggtgatgtcagtagcctcctgagcctcatattattggatattgaatgtgggtaataacgtggatctcactgggctgtcgtgagcattaatgagttaatgcctgcaaaggatttagatgtggcaggcccacagtgagtgctcaatagctgacagccagaactgaagccatcccacggttccctcccccaggcccccagcgcacagtgaggattatgttggatcctgaggatggagtatgagacaaaaatggcacaagagcaccattgcccgttgagtttggtatatctggacgcatcatttttttggtgagtctgacatagcatttccctccagcgctgagacacggcatccattttttctagttgagtcctggatgaacgagttggctgactttaggggccagtcatatggtaggaaaaattgtctgtctttaaagagcacagttgcatttgcctgggtgagatgttcaggcaggagcagagcagggaagagcacagagtctgggaggctgggtgtgggctcccattccatgcttgtgtggggcccagcgcttggagagcagctgagatggccggtgctgtgtacacacagatgaaattgcctaggattaaagtgcagctgaagacttcattgtcttgaagacaaggtcgggggtccaggaaacagcattggatatattgtagcccatccagaattgggccttttaaaattcattttcaaccttctgattgtatcaaggagaaagtttcaagttccttatagggagtccttaagcactaatgagtgctaatctctctctattttattttatcttattttattttattttgagacaaggtctcactctgtcacacaggttgaagtgtgatggcatgatctcagctcactgcagcctggaactcctgggctcaagcaaacctcttacctcagcctcccaagaagctgggactacaggctagtgccaacacactccactcatttattttttgtagagatggggtcttgctatgttgcccaggctggtctcaaactcctggtctcaagcaatcctcctgctttggcctcccaaggtgctgggattatagacaggaggctctgtgcacagtcaaaaatcttttttttttttttagatggagtctcactctgtcacccaggctggagtgcagtggtgcaatctcagctcattgcaacttccgcctcctgggtttaagcaattctcctgcctcagcctcccgagtagcttggattacaggcatctgccaccctgcctggctaatttttgtatttttagtagagatagggtttcaccatgttggccaggctggtcttgaactcctgacctcaagtgatctgccggcctcagcctcccaaaatgctgggattacaggtgtgagccaccgtgctgagccaaaaatctctcttttgaaaaaaaggaaatccagccccacagacagcctccagggctctgtatcttcccagaatgtacacatcgtgtttgttttttacgtttaggattcttggctctttcttctggccagcactggtgagctggtggccgagtatcctacctggggcacgagcctctgcagctactctaaaggtgaaatcttacagagtcaaaatcggccttgaaaaccctgtaaatatcctgtaggacagtgcccatgactctgtggatttaccctgtgcatccgttgcatgtgcatccgcaccgcagacgcaggagtgctcagcgtctaacagagtgtacgtgccaagtcacatgacggtgcttcttaataacatctttattgccatataacccacacaccataaaaatccatccttttggaaacaattccctcttctgcctcaggatgcacgccttgtgcacgggctttagaggttttagtagaagcacaaagttatgaaaccatcgccacgatctaattccagagcgttttcatcattccccaaataagcctcacacctgctagctgtcagggctcttcactcttcaccatcactaatctactcctgtctctagggatgtgcttatcctggacatttcatataaatggaatcacacaaacatacaaaatgtggcctgtttttttgtttgtttgtttgtttgtttttcagaaatgggtcttgttctgttgttcaggctggagtacagtggcacaatcatagttcactgcaacttcgaactcctgggctcaaggcatcctcctgcctcagcctccccagtagctaagactacaggtgtgcaccactacatctggctaattttaaaaaacgttgtagagacagattcttactatgtcggccaggcaggtctcaaactcctggggtcaagcaatcctcccaccttggcctcccaaagcggtgagattacaggtgcgagctactgtgccctgcctggcttttttgaattgcgtatttttaagatttttccatgctgtggcatgtatcaatatttcattcatttttatgtccaaatactattgcattgtacaggtattccacattttgttcatctattcattatgtgatgatgtatttgaaggagagagagaagcaaaaagagacggagacagaaagagtcagaggcagagagacagagataggcagagagagagagagaacccagggaatcctgacactggaattggtagggtcaagagcatgtctggggtaccacagtatccaaatgggaacctgggtcagagcaccaggcttcttgccctcacttgctgtgtgactccaggccaaccccttaccctctctgagtatcaatttgctgatagagaaggaggctgtggatccccggaaacatctctaagctccctctcttggactttctgccttcctggcaatgctgtgctgaggggtaacacaggaaagcttatcagctgttgccacctggctggaagaagcttacagtatcatttcctaaaatctgattttgatgtggcgggggtagggtgctgcctaaagagtccataggagtcttttagtttgaaactgtagaagcccagttcgaaatggcttaagggaaaaagacataaagaattgatggctcggtcactgaaaagatacagggaatgtctagctgccagcctggggtggagacagccaccaccactcccatctctgagatgcatgaagtgagtgcatgtgccccactgcaactgcccctgcatttgccgccaagttgccatctgatggcagtgactggggtcagggagagggaggtcgcatggggccgggggccctggaggactcatctggtgggggggaagggcaggaccaagcatgtgccagtgtctcaccggagttcaccaacacatcacaagctcaaagataaaacttaagaatttcaagacagtgacggcacggtatgaaatgccttctgattctgtgccagccctgactgttctttataggcaatgacaggttgtcaagggtaatcttaagcaggcaccctgtttactttcgtgcaccacctttagaacataatcctctttgcgccctcagagatccagaagaaggtttggtccgtgtctgggtgccagcagagccggcattcacattttcagttatgatttcctttttctctgtacatcgttctttctttgtgtcttcagttttgctgggcacaggcagatggggtcttggaggttaaccttgcctgttgtataagtccgcagagtgggccccaaagcccccctgctggtcccagtcctaactgcggctcaacaaatgcatagccttgaaccatccagccaccagctgtttcttcatctgtgcaaggctgaagtggagctggctcctccacttttcagagtctgagaattgcaggatgccctctgattcattccccccacctcctaccccacccctgcccagtcctgacccccacacccatcccattctcctctccttctccctctacctcctgctgcccagaatcttctctcttgtgctagccctgagttccaacagaaccctgtggccaggtctctggggagggccacccaaaggccccattccaaaccctgcagatcctctggacagggagtggggagcaggcactgaccaccccagagacagcagagagggatacatgctgagagacacatgctccatccgtgtgacttttgcttctcggaccacgtgatgctgaaatgtgattcatcaatattttgtgcccagaagccatctgcagaatctaacagcgaggagcttggtgcaatgtctgacttcggtgtctgctgaatgtgtgctaattccctttgtacccaacacctctccaaaaagaaggtgtcaggtgggggtgggagctaagggctgggaggcagcttcctgggagactgcagcagaggctggccacaccacgggtgtggaatgagtgaagctgcagtctggaatgagtgaacctgccaggactcccagggatccctggaaatggagattggataggagctccagagagggagggaggagctgggatcaaggggatcagaggagactgcagactgaaaaacacaaaacagaatgagccaggcagagaaggagagactttggtgtgaaaggcccagccccactcttcacatgtcttcaatagatatgtactgagaacctactgtataccaggcacagtgcccaggcctgggcatacaagattcccaaggcccctgctctactggggctgatgctctagctggggaggggtgatggatagtaagcaagaaaacaatggtaaacaagaaatccatattatgattgagtgttgtcaagatgattaaacaagggcattaagtagagagtgtgccaggagtggaggggctgcttttccttgggtggtcagggaaagcctcatcataagaatgcataacatcaaaacatgctggtcgctgtcctcagctcgtttactgttgtagcagacaccaatatgtccttattaaagcagcttcctctccctcctggtcaaagaaaacgaccacatttcccagcctcctttgcatttaggtcctgccatgtgacttaaattcaaccaagcatatgtggctggatgtaatgcaagcttcttataggtctggcccaaagaacctccaaatcaacatcctcttgttccacctgccagccagaattacagatgccagtggagaaggtggtggagccaaaagaagatcggagcctggatccctgagtcactgcatggaaggcagctgctcaacaaccatgtgagctggaaaacaacttctattatgttagccatggagacttagcagcgtaactgtcagttccagtttgcctgtaattgtcctggttttagcactgaaagtcctgcttcctggggaacccctcagtcttaggcaaacctaaatctaatcaccctagatttggaggtcatttggtatagcaattgagctgccctgactggtgtgtgacttataagatcacacaccaatcttataagatgggtattactattatcctcattgtgtagatgaataaactgaggctgggaagaagttatttctcaaggtcatcttccagaaggctacttagctagtaggggagccaggaattaacgaggaagtctgtccctgagtttgcacttcaaaccataaggttgcactttcttttcggggtcctagtgaaaaatgagaaaggaaaaatctggtggaaatgcatctcaaaggcaacctgaaaactcctacttcagaatccacctatcacatctgtgtctattcatggttccctgattatccaaggcagacagaagcatgtccctctctggggaattctcaaaacatcctctccctataatatctgcaagctgtatcttaaatcaatttttccacagtggagggtggattccacaaagatggagatgttgttgtttcagatttatattccctggaatccaacactacctccagcctacagtagatgtttaagaaatgtttattgtgagacccaaacatttaccaagagctgaaggacagtgcaaaggagagtaacagagagatgcacaaaccagaacaaagtagaagagatgcgtggagaggcagagacagacgtggcagagagccatggtcatcacaacccctccgagtccttatccataaagtgaggatcatgatctggctctctgcggtctaacagaccagcctgcgagttcttctctgtcgagtctgcagtggtcagagacagctctgagccaagggctggtgttcttggtgggagagtgatgagagacatctcgaacgagacctggtgagctcagcgttctaatttggattcttcaggaaacatctgattacttggcacagggagaggcactgcccagcccaaaccgatgattttccttttgaacaaagggataagtcactgtgatcccctgttaactgcctggcaggattccttgggtgtaccagggagttctccatgcaacttgggtatcaccgggaactccctaccttcctggttggaatatgtccctttatttccccaggaaaggatcccagaaaaggagagacccgaaaacctgagctgactggacacaaggaggagaagggacgggcttcatcatcagacacacaggaccctttcatttctggagatgcgattcgatgtgtcaggctgtagtatgggataggggtctggcttagccctgtcttccatttctcccagcccactgactagttcatgggtgagcactggacccaggctgatccaatctgtgcaaatcctgagacttttgtagattcttgctggcaatgctgatctggtaggatttcacccttgaggtgttggatacatctttatcagcacaaaggcagagcctgccagacagtgaagccaatatagagggaagccaagagctggagggcttcctgaacacattaagcccctggatctacctatacctgaagctggaatttcttgaacttttttgttacttgagccaataagtccccatttgtagtttaagtcagtttgagttggaattctgttatttctcgcataatgaactggactgtatattttttctgttagtcaacactaccaagaagccagcataactggggaaaaaatagtctcttctaaggcgggttactgggagaattatatcagacagcagaattcagaaatgcacctgagagacctgcttagtcaaagtccagcttctaggaaggcccattatttaaactgtcttgaactctctctgtgctggtcactggttaatggtgcatttgtcttcaggcccactgcctgcccttctgctgggctctgtcccagggagcccggccccagcttccccagactcccttgtctttgggccaggtttggccagtccaagccactgctggggccatggagcatggaagaagggagaagccagggtttttctcaccctctttttctgccagggggcaaggctatgccttttctgtggctctggcaccctctgtggtctcttaggccaaccttagccttgctggctcgctccacaccagtcttcagcctggcccgccagccggccgctacggggtgatgaattactttcttccctgggaaaatgaatgttaaagttacctgttcgtcctttgctgctagcttcagtgtggttaggagaaaatagttaacccatttaagagtaaatattttgaggttgaacttaccagagacagagccaagcaggtttccaccccatgaaagcaaacatggttcagtagcatccccacagacctgccatttcgctgctaaatgggaaagtgtctgctaatgatattggcattctggtgactggaagaagtcctattcaggacaacaccaggacaaagttcccagtattttggttcatatgcatgtaatagatcagcccaggacaaagtttctagtatttttgttcatatgcaccttatagatagcccaggacaagatttctagtattttggttcatatgcatgttataggtcagttacattgatctatgtactagctggggtacaagaacatgtgtaaaatatgttgatttcttatgcctgtgtaaggttaatggcctaagccagaattactcaagggcttttcagggaatccgtgtcctcatgtgccctgctcgccgtgcttagattccaaaaagatacagtgcaaggaaaggtgaggtgagctgcacaatttttgttccggaacaatcctctggtcatgaatcccaatactttttactgccctgataaattagatgggcatttactgccttctctttgcagtgtgggaacacaggcctaagaagaaaacaagaaaggagggaggagggatgaagaggtaagcggtaaatgtcaaagtcggcctggcccaagccctgagacacgagagcagcttgtgagcagttccaggtttcaggaggaatctgtcattcatttccaggcacgccatgtacttgaaatgtcattgtctctcacctgtctgggggagctgagcaagactgaggctcatgtaggctccttcctccccgcattccctgtcagccactgtctacctctgtccccagcggaggaaggtgattggtggacatattgatgtgtatggagggggatgcatcctgattccacgagggaagaatatgggaactctacgtttgagatcatcccagacctcaccctttgtgcctcttcatttgcctggtcctgatttgtaacctttataagatcgtaaccatccatatagcacttccctgagttctgcgcattgttctagtaaattaggaaaactgagtggctcgtaggaatcccttatttgtagccagttggtcaaaagtgtgggtggctggacccacaagtgaggggtgcagcacccacttgtccctctcaccctgcatcagccaagtgggatgagaaacagccggatgccaatggccaaagggagctcttgcatggtccacgtgccgttgaggtttggctctgccaggggaatggacagacctgggctcagtcctggctgtgcctgctgctagcgtgttcctttctgtggcaataagattgagaacagacttgtgcgatctgctgagactgggactcatttccaagtcctcacttgaagtgccctcagaaagaagtgaggaaggcatgctgcaatacttcaacgccattcccaggcacgccacctgggttggtgcagactccacaagttcaggacacggtccccaacaagactgccctcccttcacacaccagctccaagtccggccacccacacttttgaccaactggctacaaatcaaggattcctacgagccactcaggtttcataatttactagaacaatgcacagaactcagggaagcgctatatggatggttacaatcttataaaggttacaaatcaggaccaggcaaatgaagaggcacaaagggtgaggtctgggatggtctcaaacgtagagttcccatattcttgcctcgtggaatcaggactcatccccctccatacacattgacgtgttcaccaatcagcaagctccccctaggaacccagaacaaaagccagacacattccttaataggaaaacagggtgttggacacaatcctattccagccacacaccaacccatcctcccctctgctaccgcccagcggtctcctcccaggttagagaccaaaatgcatcagcaggaaagccgaggttaataatttgagtggacagaaattgttttgcctatgctttatccatttctcctccctttgaggtcagaatgtgtgtttttcttgggaaaccacctgtctctcactctcaccttactcgggtgtcctggactgaccctaggtgtgagtaggtgacccaggcctggccaatcagagcatcagattcaccagctgcctaggaccccagtcggttcatcaaaatgcaagtcttaaattgtcactgagattgttaaacagagagacattctttttatgctggattttatgttgagattgttaaacaagagagatattctttttatgctggattttatgttgtgataatagaagctgagaaatgcttggagacaccatatagagataatttgcctacatagggagccacaaaatgcaaacagagataagtgattaaaaagccagaaaggccgagtcctgatgaaaagatttaagcccttggatctagccaggcctgaaatccatcagatcccctctggacatttcaatcatggatccaaagaatttgtgggagtttttttttgttttgttttgttttcattttctttaaagtccagcaattttacttgaacttggtgttggtcatgatgggtcactattcacaggatgcagcctgctcttttaacaaataatttccaaggttttgtttttggaagtttttttgaattattattttcggtatttgtattgctcccttgctgcattgtcttttttttccttgagagattccttttatctgtaagttagttcttgtctctatcaacacaattttttaccctctctcctaatttttgcttcatctgacccttccgtccactattatcttctctgcctcctaaaatctttaagacaattattttatcaacaatccccccttctccctaacatctccagatgactctcccagtccctccacggaccagccttgcctgtaatctgactctctttgaggacaagcagcccctctccaaggaagctctctttgtttccctcacaattcaggcgctccaagtctagaggcagggtcagccccctctctgtttttcatgacaatcaatatatcactttccttcttcctatttcaaaagcacatcttgcttgaagctcttgccatgtgtctttaactcccgtccaacattctccgcccctcatctggaaacatcccactcagtcccctttattcagtaaagactgaagctcttggctcactcttttttttttttcaatctcatctaaggccctaacatccactcaggttccaatcctggctccatcctttattagatccattactgtgggccaggtgctgaatttgcttgtgcctcagtttcctcactggcaaaataggactaagtggtccttacatagttgttgtaatgattgaattaaagtgcagaaatgctcagaacagtgcgtggcactaaatgtagtctgttattattattatcatcatttaaatttttatctggcttggctggaggagcacaagtaggcccttagctgaagctgaaatgtgaagactttttaaagaactctgtgatttgattttggtgtcccagaaggtagcatcctagaggtattaatttataaaccattcacaggaaataaagaataaaatgtaactccttgcaagagggcttgtttatatattttataagtagactttaccgcttccaactactgatcaaaccagctcgccatcaactcatgataaaaagtcctcattggtaacaataggggaggaaacaggagcatttcctacatccaccttggtgattaccaatgtgtgagacctttgcagacccatggatgtaccaatatcctccaagggtgtgttggcatggccacctcctcccaagacctccccataccacacatcccccaccaccggcatctcatgcccacaccatctgatatggtttggctgtttccccacccaaatctcatcttgaattgtagttcccataagtcccatgtgtcatgggagggacccagtgggagataattaaatcatggggcaggtctttcccgcgttgttctcatgatagtgaataagtctcatgagatttgatggttttataaagaagagttcccctacacaagctgtcttgcctgccaccatgtaagaagtgacttcgctcctcatttgccttcctgcatgattgtgaggcctccccagccatgtggaactgtgggtccattaaacctctttcctttataaattatgcagtattgggtgtatctttattagcagcatgagaacagactaatacacaccctctcatcctccctgaactttccaccggcatattctatctctggatttcacatcatcacacaaggcattttctgaaaactcctgtcaccccctcctaaagtgatttgtcaccagcaaatagagtgatgggaggagcctctttattaaccaagagatgattcatagggctgcacacaaagcctgtgaaaagcaatgtttattttcttgaaatgacataaaactatcattaatcatcctacccaacccatcctgagcgacctcctcgcttgttttaacttctacaaattaatgtaaatcactagattcagggtgcatatttggagtggagggtcagaagagccggccagaagacctttgcttctgtttctataaaacatcatacactaagaaaaaaacacatttccatttctttctttcctataattggtcaggggtcttccaaactcgagtctgttctttgtgaaccaacatagcagaatttaattttgtaccccttctcccctcatagctaaaccttgaacttaccgactggagtgaacaatgaggccaccatatggaggacagcatcctggtctagaaaaacaatctccataatgcaccagcccatccaaaaacagactgaaattatatgttgaagcacagtggaaatttcctcctgcatgttttatgtaaacaagttcatttgttcattcaatgaatccacagttcttcaaaggctctgtttatattaaaagaaagaagcagaaaaatttggattggcgggcagccagctctacacctacagagttgtcaagctgttagagcaacattcgggagctccgatgtttatgttgagatgggcttttaagccaaaagtaaaatatttttttttggatgaaacagccagatatgtgagcaatggactcacatcatcagagacaaaaagaccagtgttttgcaaaagggcagaagctgagctggtgatgggcctcagaccttgcgcagggcccgaggactctgtcttctcatgtctatggagcagcatctcaggggtttctacattagacagctttaaagtaacaaagaagagcgagtgtctgaggttaagaccttgacacacgatggtctctaggctgctgacttgaatcctcaggaaaaaatctacccaccaaaggcctaaaagttgggttctttccaagtgtgatattttatatttactatttagaagaccatgcagtaatcaaatagcagcttcaagagaggctctatgagaaagagtgtcttgtatccatcaggattctgtggttgcaagtgacagaaaatcctaccccagttggtttaatccaaccaagtgtttcattgaatcacagacttgaagcaggatggggatttttgctttgggtgtggctggatccaggaactcaaaggatgtcaccatgtggctctttttctctatttttaaactgtgcattcccctgagttggctatattttagggtagatgttcactcgtatgaaggtggccagcggctgctccagctcagcatcgtaacttctcagcaactgcagtggaaagagagcactgctcctgcagttactgaggccgatacctgagaattggcctttagtaactttaactgggtcacatgtgcatatcttaaccaatcactgtggtcatgggatagagacttctgattggtcagacccaggtcacatcatagccctggactcaacaaaactacctgcacagggagtggaggaggggtggctcgcccaggaaaatagggttcattacaagaaaaaagggaagcgtatttgaagcaaggaaaatttggtctgaaaaacatttaaaattgtaaaaaaaaaaaaaaaaaaaaaaaaagaaaaaaaaaacagaaggaaattgggtatgtttactttgagaatgagaataatcatgattatgacgaatcctggaatcttaaagttagcagcatcttcccagattgagaccaatagtttccagacacattttttttttagagccacagacctcttttgtcaaataaaatctaaagtctgtgggaacgtccatgatgaaaacggatcgacactaagctatttagttaaaagaggaaaagggtaaaaggaggaaaaaggcccaatgtcccaccctcttagttctcccaattcttccaacatcagctcttccttggaaattgagggaagacaataaaaaaaaactgctggggcttcaaagatgactttagggagttagaccctgaccaagaataacattgactcataccaagaaaaacttcttcccagatcaattctctttcaacctcatcaaggagaaagtcaaaggttaatgctaatacattttaataaatttcatagcccttgctaatactcatttgaaaaatcagaggtcaggttatcaggatcacagtgctctgtgggtattcggctagaatttactatcaatattttcttcttactgcttttgttcttactatttccttctatttagggaaatgattctggttttccattttatgatgatgacatttacatgtgtgtattttcttattttttcttttcagtgaaatttttttttgtattgtggcaaaatatacgtatcacaaaatttatcattttcactattttaggtggaaagatcagtggcattagatgctttcacactgttgtgcaactattaccacatccacctccagaatttgtttatcttctgaatggaaactgtataccctctgcaactcctcactccctccctgcccctagcccctggaaagtatatatttcttttaaatccatgtatataagtaaaacacacagatgtaggcaaataaaaatgtttcatagattacagtacagatggtgcaaagggaaatggataaaattgtgagagatgtttggaaaacactagaggagcttagccctcctaaagataaaaccctgtctacagtatccctgcaaactcacagccatggttcgaaccttgggaataacagagtttcctcctttgcaagatggcctgtttcattttgcacatggttctagaaagttcttccttccatcgagctttggcctgaggactggcactgcaccaacgggtggtgatctttttcctttcccactctaatgacttggatattcgggtttcgtggccgtgttaaaggtctcccttcttagctaagtatcccatgtttgcttgcagattaacaccaatggtgccgtgacatcgagggaccttttcagcctgcccaaccctgacattcccatctctggccacacctgcctggtcttctcttgggaactgccttaactctgctgtcattcatgttgattagcaaggctgactctaccccatgacccagagctgaccaatcagagcagtccattgcccaagccacagtgattggctcaaaggtgagcatgcaatcatgcatggtcattaaatccatgaaggtgctctacccccagcctcaccaaccacctagccgtaggggctgccatagatggctccttaccctccctttaatcagtggctttgggccttttaaattctgaaaacatggctgtgtccaaagataagggacacatggtttttacccataatttctttagtcatgatttctaacagcccctgccaccaagcctgagccccattctaaacgagttaacccattctaatgagccaatacttgtcaccttagaaggaagatgacaaatgttagctcatttaatcttcagaaccctgtgaggtacctcctaggactatttttattttcaggtgaggaaactgagtcacaaagggctgtaataacccgctgagggttccaccttggcaggaatttgaacctgggcagcccagccctgaatcagtcctcacaccacccatgatgcggccctgagagctgctctcaatgccactagcagagcgatgtcacgaagtgccactgtggcttttactgtacaggattttctctctttcaaagttgactccatgccagtactggttgctctgcaaggtctctcaaatagagtgcctttgatcctgaaccttttcttggaagcctctgaagggcttcactagtctaggggccactgcagatgaccatctttctagcatctcagctgtctgctctcatatttcattatctggtccacaaggctggtaacaaacactcaagataaattctgtcctccctctctggaaaatagaaaatacattaaaaatctcagcctgtgaaactgaaaattccagccaaggggcccatgaggccccagactgggaaggcccagttcccaggagacagcagagtcctgctccgagataacatcacccttctgcccacacatgcagaggctgtaattataccccttaacctggggctttactttacttaatgagtaatttgccaaaaccatgctactgtttgaggcatgaacctggtgtgtgaagggttcatgtgcttctatcccacctgtcatcttcctctccaacatctgggatcctgggagaaaatgtctgtcaaccacacagctgcctcctcaccctcctgcccccaggtactctcctggtttccccagcatcagagttagctaatgaaagaggccttcaaaacatttctcaaaaagcatgggcattgtggaaaggggagagagaagctgggtttagcagtgagcattagtaggggccatggttggtcagaggacattccacaccaaggtgccatcatgcaggagagtttgaggacagccagaaagtcctgtctcttcctaaagaggagactacattcattgggcccactctcctcaaggaggttgcaggagtgagatggtttattagggccaaaaatggacctcagtgagttgctgaatagaaggcctttgaattggccaaagcatcgttgtttgaggaatagataagcgttcgtgctcctttccttaaagatcttggaagagacaaaacccagggtctagcagaaactgcttgctgcccaccccctatctagtcttctcttcttctttggaaacagaacccccagtttaactggatacagggctccctagaaggaagatgactttgcccaccctccctttactaggtgaggtcatgtgataaagtaaagatcaatgtcatatcataagaagtctctggtgaggcttcagggtagagaacaggttcaggaggaatatacaccttttgtgctctgattccattcctcattctagctacctggaatgtggatgttatagtggtgctcgcagccatcctggattatgaagtggccatgaggactaggaagtgaacccgcatggataccgaaatccacaaacgctcaagtcccttatacaaaatgaagtagtatttgcatataagctatgaatatccatagagtagcagaaataggaaagttctgtggaccctattgacttcatggaacttccgtatcagtcatggactgtttatctctcaaacttcctttaagtagagtataggagtgcatccctgtgtcgaaggctctcttgtattgaactttctgttctatgagattggatctacccttactgatataggggactcatgaggcttctcagggaggggcagagctctgaggatcaagccaacactccacagcttgcacttcaggtctctcgtggtcagggaccaacacttccactgaacgccatgccctcctgccccaggacctaccaggctctccacccagcctcttcctttgcacccttcctgtgcttgtcatgctttccccactttctgacctttgcctttgcagaaagtcttgctggggccaacctcactaccttctctccacaaatctcaccatgcctcatggttcaacttttgacttttacctctgtagtctttcccagatattctggaagatgccttgctggattgacctatgagcattgaaacctgtctttcttttcttgttccacacgggcaagggtttcttaccccaggactgtgggatctttcagggaagggctggcccactttacttctctctttgcagcacaggccttggttggggaagtttcctccacgtatttgcagaactgaactgctcgggacggttctgtctcaggtggtcctggctgggtctctccaccagattgagtcaagagaatgtcttttccagccacgtgcagaagagaactcaagttcaccttaatgaatgcatatttgtgactccctgggaaagtttaatgtgacacgaaacacacattttgcacactctgctccacagcccagcatgcttgtccacttcagcagccagactctgatcctcatcacttttgacaaagctctgtgagaccaaccctgctggcctctcttctcactgaatctagccctctggtttactctaccccggccaaactggcccccttgctgccctctgaacagccaccacatgcgtgtccctgtactggctgttccctctgcctggaatgttcttcccaaatctcaggcaaatgttacctcttcagtgaggccttcattagccagcccagctaaaacagctgcacttcctacacccccacacattccccactcccaccactcactcactctctatcatacttttctttctcagcacataccaaaatctggagtcattacctgtctttttctctagaatgtcagttccatggaatcaggcccacttttgtcttttctccactgtatccccaggacccaggacaacttttacatgaaaaataaatactgacttactgagtgaacaagtgaatgaatgaatgggtgagtgaacaaacaaggtgaattattctacctctttcaaactgtgactccaagcaagtcagtgcaccttgccagcctcactttcatctgcaaagtggtgctaattaaagagagattagattcttttcctccaaagcttgtacaaagagaagctgttgctaaaccacgcattgttatgcagaggttatttaagccaattaaattaagctgtcacactagccctgccagcactctccagctcgttcacacgtgagtgggtggtgtcttgcccaacgtcccggagcaggtctctgcagagctggcttctgggctccttcctgggctgcactgcagcccgggacatcatctactcagaggtgttgactgagcccctatcctgtgccagacattgacatatgcactgaggctacagccgtggagaagccagactctcctctgcaagagcttgatctagtgaaaaaacaggtgctggaccagcaggagagacaacagtgcacaggaaacatttctgagctggggcgagttggctggggcagcaacccaggcagagggcttctggaaggcctctccaaggagggggctggatcctgaagggtggacagagattagccagggagacaggaagggaaggctcatccagtgagggaacagtacaggccaaagcctgaatcatgagagaagggtgaacacaaggaaatgaaggatggcggaccgtagacaggggagagacgccatcatgcttctggcttcaacaaatcagaagggtccagggattcaaaggggcagagtagacccagagacccatgaggcggccccagagtggtccaagcgtgagatggcggtgctttggactgggtgtttgaatctttttttagtaacagctttattgagagataatttgcatatcatgatgttcactcttttaatgtatacagttttgtgcttttgattaaactcgggaagttgtgtggtcatcatccctatctattccagagcattgcattatccccaaagaagccctatacccatgagccgtcactccccatccactaccctcccaccataggcagccactgctactgtcggcctctgtggatttggctgttctggtcatttcatgtaagtggaatcagacgatatgggatcttttgtgactggcttcctctgcttagcataatgttttcagggttcattcacgtggtagcatgtgtcagcattccattcctttttgtggtagaataatagaaatagaataatactctgaatgcatatgcggtagtcccttggtattcgtagaggactggttccacgaatcctgccagcctcccttctcactgaatctgccccctggtttattccaccccagccaaactggcctccttgctgccctctgaacagttaccacatgcatgcctctgcactggctgtcccatcttggtatcctcatggatatccccatggataccaaagtccttggatgttcaagtgcctgatataaaatggagtagtattcacatttaacctacacaatactcccgtatactttaaatcatctctagattatttataattcctaatacaaggtaaatgctacataaatagttgttatactatattatttagaaactaatgacaaggaaaactatctatatatgttcactacagacatgatcatcataggactgactatattcttgatgtataattggttgagtcctaggatgtggaaccgtggatatggaaggccgactgcacaacttttcattcttttttgtttgtttgttttgttttgttttgttttgtgatgaagtctcactctgtcacctaggctggagtgcagtggtgcgatcttggctcactgtaacctccacctcccaggttcaagtagttctcctgcctcagcctctcaagtagctgggattacaggggtgtgccaccatgcccggctaatttttttttttttttttttttgtatttttagtagagacagggtttcaccatgttggtcaggctggtctcaaactcctgacctcaagtgatccacctgcctcagcctcccaaagggagcttttcattcttgatccattcatcagttgatagacatttgggtcacttccactctgggctattatgaataatgctgctgtgaacatttgcatgcaaatgtttgtgtggacgtgtgtttttgtttctgttggatatatacctaggaatggaattgctgcatagtgtgtgaactctgtttaactttttgaagaagcatcagactgtttgcctgagtggctgcacactttgcattgccactggcaatgaataaggcttctggtttctcacaacctcaccaacacttgttattgtctgtctttttgatttaagccatcttcgtgggtgtgaagcggcatctcattgtggtcatgattttcagttccctaaagattcctgatgctgggcaactgcatgtgtttactgggcatcctcatatcttctttggggaaattcctgtccctctgctcccccaagtggctgctaggtggctgctttctatagctgcttagttgaggtggttggttttcaaggctaccacggagctggggagatggggatgggttagggcaagttgaaacaaagcttgttctttctgagattcagcattttcctgaataaacatccttgtacagtttaagcctttggttaatatccagagttctgaaaagtcgattttgacagttgctttttggccagtgttcttattgttttatggaagagtagatttgggaaggtctttactctgctattctggaagtgcctttaattgaagtatccataggagttaatatctattaagggcttactctggtgtcagacacttatctaagcattttgcatatttaatgcccccacagcccaaggagaaatgtattattatgtccattttagagatggggaaactaaggcattcagtgactaaaggttaagtgacttgctaaatattccccagctggtaagcaggtggggcgggaagtgggtgggaagaggaggagacagcaggcctctctctggctccagggcctgtgctttgaccacctcccgtcctgtcctctggctgctcatagagtcaggaggggcctaggaacccaggccagcttttccccagggtggggaaggaaggattttgcagctggggaagaacaagaggctttccttggtgcatgcctcactctgcctagctcagccatacatgctgtaaagccagccatgacctttccggaccaggggttggagtgggaaaggaggtgtgcactgggtcaaatgggcagcaaagaaggcaggtgccctgcctgtgagttggcagtcaagggagcctccatgcagagtctccattcccaccccaccctcgccctcagtcagctgccacaagtcagcccactcctgtacctgctgcagcccagcccaagagctccaaaagctggggctgtggagcactctcactgcttggcattttctcattggtttgatttgttgttggggtctgagtgttagatcagggagggcaggtcttgtgtgtttagctttttttgtttattgttgcttagctttttttccattgcaccttgaacgatgcctggcacatagcacgagcttggtgaccattttggggtaagtgaattgattcattcactaagaattaatttgctaagaatgggctgtcaacctaatataatcaacagggtcagaatctagtttaaagagaatttatttaagtgcaaagtgtgaggacaagctgcctaggaagcagagattccaaagaatagaagtcaatgttccaaactgtagaagtttgggatttttatatagacaaagcttagggaggcttaacagaattccaatctctttctatgtaaggcttaatgcatagttaaaatgatctgattagttgagatggcttttgttttccagaaaggtgaatttaacattctccatggaagatgtaactgtcacggggtcttgggcaccatctggtctgagttaggtacaggacaataaaggagacagttaatctataacaaagatcagtgattggaaggaggagaaggtctgttctttggtctctcttagtcatttatagcaacgagaacaatgaggaagacagttaagctctaatctaagaagcagaactgcaaatatgcagccgtggctcagtcgccagggcttaacttctcccatggcataatacttttagacagttctaaaattttattttcttttacagggctcacctgaaacaattatattttaacaaggcaatagtaagaacaacaacaccaattcccaccgagggctaactctgccaggcacagttccaagtgcattttgcatattatctcatttaatcctctgctgatgtgatcgtgttatgtgttattatgtccatttcacacctaagctctgtgtttgtgctccgaatttccatggaaggagccactcagtgctctaacacttggtgtgtgagtcaccccagaagttccctcccatgtccctgctggagtaagaggtgctatgaggcagtctctcctgcagggtcttgggcctagcaaagtccactaggccattggcttccaggctgtcttgtccctgcatgaagactgaggccgctttggggaactttctgctgctaaaagttaataattctttaaaaacacacatcacatactatgggcctggcattgtgctaagtgctttagatatgttaacattccatccccaaaactctggagtgaagtaggtgctataattatccctgtttttttaaatgtggaaacagaggtgcagagcagctaaatatcttgtccaaggtcacacagcaaagtggcggagacagtctggcctctaggtctgtcctctttaccactgctccagactgtcttttgatgaaactgcccctcactggatatgaagggagacagagatggtgacatggctggagagggtgacagtttccccatcgcagcatcaatgtgtcagttaggacttgtttggttgcaagcggcaggaagccatccccaacaggctcagcttgaagctgttttacttcaggcatggctggatctagaaccccagatactggaattaggaccaagtctctttcagggttcagctaggattacctctgtggtggctgcattctcaggctccatgggttggcaaggtgagtgtcaacaattctgcacccttgattaatctcacctataaaccccgtgggaagagacagtctttctctaatccctccggtgaaaagcttggaattacctgtctttgaatctgattggatagccttgagtcaggagcccccccccctcccccgccccccgttaaccaatcatcatggataagggaatgaagcagttctctgattggtcagtcctaggcattatgtaaaggccgacagccaggtgtgggccagctccaactggggcgacttgtggagggtggttcctgggacaacgcccatgccgtgatcaggaacggggtcagcaggagtcaggtggggaagtgccaggtgtccactgccacgaccaacacgttactcacactcacggcacaagaatggcctctgtaccctgtgtgtaggtaggtcagaagcttttttgtttgtattttatgacttttatagagttatgatgacatgtatttttctcaaattttcatagctgtctctctaatgaactacaaagtagggcgttcatggtccttctgggaggtgtgtgactaatgcgggaatttcaagcaccatgacagggcgaagggagcagaaattctgcaggaaaaccggggggcggggagaacagtgatgtgacatcattaggctgagaaagaggtagatatgggtcctcgtagcaaacaggaatgacactggttaacattgaaggtactctctctcaagtgtgtcaggctctgtcctaagcttgacctgcatccttccattggaacttccagacgactctccgaggtggtgtcccatttctctgtacaggcatatccaggcacagtcgcttgtatgtctgagacctcaagctggagagtgctgatggccaacatgctggtcacctctccacagtccttcctcctcctggacaacacccctgctctctctggatggtcctgagctaagcccggaaggtgaatcacaggggtctaagtcaatcgcgggatcccacctctctgcctgtgattggtggacattgagccacttctgaccaatgacgtgcaagggatgtgcttgggggattctgggaaaatcttttctctgtaaagagagggggctcatgaggagcatgttttctcccctggcctcatcccctcctgccctgggcattgtcacctgacccctcctccccacctccactgccaccaccttaatccaaagcacagcatcctgtgttcgtttgcttggaatattctggtcttctcctccctggtctcatgcagcccgaggattctgctcaaatccaagtcaggccgtgttgctcctctgctcggagccctccagggatttcccatctcacactgagtcaaagcccaagaccccatcactccccacaggaccccactgacccccgcccctccccgcaccctcccctgcgtctctcccttccactcactgtcccagccaccctggtttcctcacaggcccttgacctccccggcagctccgtctcaggcctctgcacgagctgctccctgtgcagggaatgatctaccctagtaacccccatggatccctccgtcccccaggtctctgttcacaagtctccatctccactaggccttccctgtcacagtgtctaaaatgcaaccctccccatgccctgggcccccacctcttcccagtttagtttctctgatacactacctggtacaccgagctatttggtttgctgttccgcttgcccaaccagaacagcagctctacggcggctttgtctccctcatgggcccccttttggggcctggggcagtgctgggcacgtggctatccccaaataaataatgactgaataagtgaatgaatgtacatgggggctgtgacaatgtgtgaccatgagggatgccttgggggccacatgaggccagaggagactgggcagtggcttggtgactctgtggagcccctgcctggccatggccctcccgcctccagagttctcctaaggggtaagaaaaggcctccattgctggcaccttcacccaccgcatctcccgttgttgcagccacaattttcttacaaggacagtggctggatttgagcccaggctgtgtggctccagacctaagcccagggctttgtctggggtgtggcccaggggcaggtccttgggtgtgtgagggtggcttggctcagctcctctccctaggtcactgcagcggccctgtgctgttctgttttcccatccagaagtcctgagggtctcagcagaggggcccaggatccaagtccatccactcccagggcgggtccctagccagcctctgcccagcatgtggtgtggatgctgccatatccttctgcttcctgaaatgtttcccttccagaactttccaggcccaggttccccatgcggggctgcctgagcacccccaccctatggccagccctgctgccctggcttccacctccagatccttcctgccatgtccccctccaatcagagccgacccacactgtgtccctcccagtggctctactgcctactgaacacgtgcaccatcaccgccgtggggcccacaggtaatgggagatgcccccaggtcctggtttgtgcttcgccagagccctcctagagctgcaggcgatgatgggagcttttcaaacaccagcagggcctagatgagctgctccagggacaggagtgttgcgggcgaatgagctggacgagggccagccctgcagggcgcgcagacttgcggctctcttcgcaggcttttggcccaaacagctctttggaaaagagcacaggaatggccccggaaggtgggacctgtttccatggtgcacgcgcaacattggaggacgatggagctgggactgctggggagcagcgagtcaagggaggggagggggcctgggtgtgggacacagggctgccctccgtccttcatacccactggtgccagctcacctgtcactcccacatgaaggccgaatcagtcaacattttccagagaaacagaatccatatggagagagagagagagagaaacttaaggaattcgctcataggattgtgggggctcataggactgtgatgctgagactggggatgggggtgtgaggggctgccacagctgtgtcctggcagcgccgagccagtcccctgtcctgtttgcagagtcaaggctataaagagggactgagaacaccgtgacgccctggcctgcgcaccctcctctgctccatctgggtctgtccggatggcagaggctcagagggtctgcccctaccagatggtggaggctcagaatgtctgagccagaaaaagcatgaaagaaaacttagccttcctcctcccagttaacaggtgagtcagatcccagtgccctgtagggactgcagaggcagctcccttctcttgcccttgactccatgcccttcttcttcttcctgcctagctgcacacatggcaccatgcaattcccctcctcctcctcctcctcctcctcacttctgctcatgtggggaaacctgtgccttatgtatcctgcaccccagggttcttggaccctggaccccagcctgtgggcagcaggccctccaagctccacccactgctcagcaccacgtccattaccccctgtccaagccactgtcctctcttgtcctggtgattaagacaggctcctgtggagtttccatgctgcgcctgcccccatgatccattctcctttcagccaccagagtaagcatgataaagtgcaattaagatgatgccactctctcatctacaatcttcaatgacttctcattgctcttggaatcaaatccaaaccccactgtggcttgcatgaccccctgtgatctggtccctgccctcacgacacatctctccctgttcactttgtactaagcacattcccacctcagggcctttgcatttgctgggcctgcagcctgaattgctttcttcccagaccttcttgtatctgaccccttttcatccttctggtattagctcacctgtcacccccacgtgaaggctgtatcaatcagcattttccagagaaacagaatccatatggagagagggggggtggggagagagagagagagagagagagagagagaaacttaagggattcgctcataggattgcgggggctggcaagtgtgaaatctgcaagcagacaggcaggctggaaattccagcaagagttaatgttgcagtctggagtcggaagggtggaaactcaggcagaatttctacgttacagtctggagtcagaattccttcctctttgagggaccacactctcttaaggcagcagtccccagcacttttggcaccagggacaagttttgtggatgacaatttttccacggactgtggggggttgggtggatggtttcagggtgaaactgttccacctcagatcatcaggtgttagagtctcataaggagcacgcaacctaggtcccttgcatgcgcagttcacaatagggttcatgctccttcgagaatctaacgctgctgctgatctgacaggaggtggagatcaggtggtaatgtttgctcacccacaactcaccccctgctgtgcggcctggttcctatcaggccacagaccagtatcccggtccacgggcctgggggttgggaacctgtgtcttaaggccttcaactgattgcatgacacccacccccactgtggagggcactccacgcgactcagaggctactgatttaaatgtcaatcacatctaaaaattaacttcccggcaacatctagatggattgtgatcaaacaactgggcagcttcacctggccgatgggacacctacagttaagcatcacggacaccctcacccccccgcccccacaatctaacggggatccctgtggcagatgctgttagttccttcccataaagcccggaacttgcagcgcgctgtgcagatttccaccttcatctctgtgcctgaggctatttctccagagtcccggaaggctgttctggtgggctagaaatgccaaagacgcattaccctgtgggagcggccctcaaccagtgactcttggtagctggtgggaaaatatcccaggcccctcgccccgcagcgggatgactctgagctgtgtgctctacactaacttgccccaggaggattgagccccggctgcacgctgcattgcttgctcggtaacaccctgtgctggctgctttccctctcctgtctcatttccccaccccttaccagtactgcctggatccccttccagacaaacgacttgcccttggctccatgctcaaagtcgtcgtctagggagctcaagcttggatgctccttcgttttcgctaatcactctctgtatgtcccctggtcttcttacaatggtagcccttgtcaaagctctaatcatcttgtttttatgtctgctttctttctgctcactggaaggctgggtcctgagggcacagtgtccagcacggaggacacacagtaaatattcccagaaggagtgatgggtgaacgaataaatagaatctcaccctgccaccatgattaaattcagccccaaacttacctgtcccattgtttccatatcctgccacctctgaggcctaatctgaagaactgatttgtgccagtggacgagcactatttctctaggtgagacatgcaggtgtcaacaggaaatgtcctgagatgtaattcttcaacccaggaagccactccaatcaagagaacataaagcaatggtgatgggatgtgggggttccatggggcttggatgccctgaggagggcctcaaatcacagaatgatgaaggtcttctggatgcagtggcagggcaggagaggtattgccctgggactcgagatgggaccacagccaattgctcactcagccatggcctgtgggtctgacactgggacctcactaaccctcttttaacactcctatctgtaagtagggatcatgacccacactttgcaggggttctgatgctgcaaaattctggcgctttctacatgataaggtctttgctcaccaaatggaagagactgcgtgcaggtagcatgggcctgcctactgcaggtggggtgctttgggctgcaagtaacagaaaatccaactcaaagtgaattgtgtgataaagacaatgcaccacctcgcttatcatggtctgagttcctccatgagggttgccgcctggtgcgtcctctgtaagctccctgaagcaggggcctaggctgaccttttttctccactgcccccgagagcatagaccagggcctggcacagagaaggcgtccagtgaggattccacccaggacaccatcaaaccctcatcgctacatggtctattaagttgtgttcccccaacagcagttaaagaaaccaaagcttggccaggcacggtggctcacgcctgtaatcccagcactttgggaggccgaggtgggtgggtcacttgaggtcaggagttcgagaccagcctgaccaatatggtgaaatcccatctctactaaaaataagaatacaaaaattagctgggcgtggtggcatgtgcctgtagtctcagctactcaggaggctgagacaggagaattgcttgaacctgggaggcggaggttgcagtgagccaagattgcgccattgcactccaacctgggcaatgagagtgaaactccgtctaaaaaaaaaaaaaagaagaagaagaaagaaactagaaactaaagctaagggaagataaattacctgcatgacatattgaagcacacagaggacagtcctggcattccctactctgggctctggccataaccctgacaaccctgctactctactgtcctccctggcctctctcaggccagtttgtcctcagatcgggcagtgtgggagttgacaaaccagtcaacccagactcagatgacgcagaagtctgcccaacacagaagtccaccaaccattgcattgtgatcattgcaccgaggacataaattcagcaacatgtgctgggtcagctgcctcgtttttctccaaagtagcaaatttatggggcacacgtgcacatgggtgattatttcccaatagtttatagtatcaagcctcctttctttcctcccaataaatctaatttatatggattggcagatcaaacagtgcatttcctggcatcgagaggctgtgagtcactcacagtgctttaggaaacttggggagattaaggttttgcataatgcaaatgcggatggaaacatatttggactgcctcgctgtggatgcaattagagcaatgagcaccaggagaaatactttttcccaggacacagcaaggtctgcttggtatgcaaagagcacagttatttgcgacaccagagcctggaacgtggtgagcaaagcacccagtgacggtttgatttgcagctttaaggaattcaaagatgaataaaacattaaattaattgccaaagaactgttgccaagcctgcatgagatctaatgaaggcacacatgcaaaaaaccaacacacacagaacaacaaaccaaaactgggcctgcgggatgctacctgccccaagcccccgaaaccacatttggttttgagtattttgtcctacttggaattttctctcatcaatactcatctcaagtcctctcagccacgaaagctctctccgcttcccccagcccacaggacgctccttcgactgtttccttgttcactggggaaatgttgactgagcacctgctatgtgtcaggcactgctttcccagacgctggggaaacagcactgaacgaaccaggccacaatccctgccctggtggctgccttcctgcggggagtatgataataagcaaaatagagaaattaatatattggaaagtgctcagtgctacggagaaaacaaagatgaagtggggataggaaatgccgggaggtagggtcaatcgcagattgaggcaaaggggtcagggaggtcccaagatgggggacatttgtacagatccctgaaggaggtgagggtggtgactacgaggaatgtcaggcagagggaatagcaaggggagaggcccggagtggaggttcccgagtgtttgagaacctgtggaagctggtgtggccgagtaagttagggggagagtgatggtgatgcacccagacaaggagcaggaccaaggtcacataaagtcaatgcattaattcacctttcaattcattcattcacttactcaacgaatcttttgaggctctactgtgagccaggacctgctattttagatcctgaaaatccaacattagacgtgacaggcaaggtcccagctctcacggggctgtgtaatggtggctgatccgggagcaggagggaagttactttgttgaggtgagtggggaagcccaatcgccactcgcctctaggtccacaatcccagcagaattccctcttttgtttgctcttaggtgattcttgtcttccccataagcccatttagcagatgagaaaactaaggttcctttggaatggaagtcctggcttctctccataaagtctggaaattagagggagtagaattaactcccttttcctttgcacagggccagcatgaggctttggggaggttctgaggcaggagacatcctacgtcatctccacaggtcatgaaccctatagcatctcccaccaagagggtcacggaccctacagcatctcccaccaggagggccatgaccagcctctggggctgtgctgctgcatgccaaggagtagctgaatcctaggagtggagaatccccagcctggaaggggaccccctccaccgactgccatcactctggggctctctggcttgagggctctctggggccacgaggccaggcctcctctccacgtccaaacaggctggctgggtgcaaaatgccatggtgcttgctctggatgggctggagttttccctattcaggggccagggcaatgggtggagggcctgggtagagaggcagagcacggttgcgtccaggctgtgccaccctgaccctgaactcaggcccacaggaggctccaggcaacagctgctctctcctctgctggggcctcctgcctggaaagcctgctcccacccacaatgcctagattcctccctccaagcagccttagagacccctttgggatccagatctgctctgctcctcaccctggggatctgggtgtcactttaaataaagggaccgctcgtgctcaccaggctgcgggatattcagaggctgggctggcagttcccatcccgtggtcgcagagtgctatggaggggagataataggtgtgatttctgtgcagaggatggacagggctccagggacagaggatgcaggagtgacaggcatcatcagataccatttgtccagcagccgctccagccacctggtgtggatgtggcctcgtgtccatactctccagagcacccggcttagtggctatctgcctggctgtctctcccattttcatgtgaaagggggccaggcaggacatggggtctggggactgccatctcctcctgggggctgcactgtgctgacagtcttgtgtccccctgacaggggctgcacagacgggccaggcagaagtgaaggagaagaaggaagccaacagaaggtggctttcagggctggtcacgcagagggtggattctgacgggcagggctgctgtgggtggtgggcaccatctatgctcatccctgcccaggcagctctgggctcccccagctcaggtgggccccctcctcacccagggcgcagctgtggctggcagcaggcattcacccccttctcagctgctcagccatggaaccaggagctaactcaattcctctgtccccaaagtctgtgcccaccaggccatccgcctcaaacacttggtggccaaggcctggggatggtccccaggctgcatctggtcagtggtcaagaggctgcacctctaggagcctcctctgtcactcacccgcccaggcctggacagcctggacactccagccagaggcagcccagagggtgtgggaggggctctctggggacagagcaggaggggacactgctgtgaccctgtagctgcagacatgtgtctccacgaagggaagaggctgctgtccactgtcgctttctgcagtgacactgtgccctggcccgggctctctgctgggttgcagaagtgcctgggtcaggacagctcgcatctgccttcaccgcagacccctctctgcagcccatctgaggcaatgtggcctctgctgtccaagactcacttcgaggggatccttttccttttttagtggaaacctggtgtcctccctttgagtgcttttaggggctggggaggaggtggctattggcggcagtgcgggggcttcatgctctgcctgcgcgcagcagagaacacggcttcattggtgggatttgtctggtgactgggcaggtgggtcgcctggacacgtgctcccagccttcagatgtgacaaggaggggaccatttgcggggttgctgtgtgctggggacagagcagaaaatgccaggcggcaccatttttcccactccccacccgcccgtgctcactcagagggaatgtacagatattctgtttgtaattaaaaagtaatttaattatccgctgaaaatgaggtttcagaattaatattgaaatgaattctagctgtgctgtatgatgtcttttctccctgctcattagaacatcgggaggggtgaggagagaaggcccaggaggaggggcgtccttcccaggcagctgtcacaggcccctagctgagctctcatggcagacacagcccaggacactcagacccagagtgactacgagccccggcaagacgtggaggagcagagttacaacccgtcaagagcctgatttcaggttgaaaccaggcttcaccatgcagcagctgtgtggcctcagggaagttactgaacccctctgagcctcccatggaaaataaggatgatggttcccctcacagggttgtcgggaggattcagtgtcctccttcaggtcttgactcggatgttgcctctgagtgagggcgtctttggccaccccatttaaagtgccaaccctgacacttcctccctcctttcccctctgtcctcttcctggctcttatcaccatcagacaaaccaagttttcacttcttgatcattgtccagcccctgctgtgaaatgtgaagtcctaagacacaggctttttttgtttgttacgttcattgctttagaaggaattaaggacaagctaccccaaatgacgtcactttggtatatggattattttgagctgcaggcactggagaaacagcaggtgcaggcagggccttcggacctccccttttctaaccaagaacaggccatgacatttcccacgagatacacactccctttgtaccaggaagagaacatccttatcaccaaacactgggagtggatgccgaggtgcatctgcacaaacacacttaataaaataaccctttgcttccaccagttttactcgtttctcccccacgaatcttccagttcctcccccacgatttactgcccccagtccaaacctttttgtctcatcatttcttcacaaatatatcatttcttcgagagagataaatgctttctgcactgggcacttcttcagggcttccttctcttgtgaaggccccatgtacacgtcaaaatgtagtcaagcttgtccactttctcctattcatctgccctatgtcagctgaattcagaactcagccagagactaagacgtgaaggagaatttttttttccttcccaacactttattcctagaacccatagtagctgctgccacatagtaggtgtacagcaaaggcctgtttgggtgaaataataaatgaatgaatgggtggtgaatgaatgaagacacaagacgcggagccctgggagcggtgactttgccataaggttccctgagtgtcccaaggccagcgctgcccatcagcccatgcctccctctccaggctgtttccttccatccatttccccaacactcatccatgagctcctgtaagtacccggtgccatgttcaggcaccctgagaacatagcggtgcaaaaatgccacatattcctgtcctcctggagtggatatttcgagacaggagacagatattgaagaagtgaatgattaagtataaactataatgtcagattgggataagtcttaggaagaaaaaacgtgctggagggaggaacagggagtcacgggcaatgcgtgagcaaaggaggtctgagaggaccgctgtggaaggaggcctgagatctggaggaggtgggggagcccggcagacataggagtgggattgggggggaacagggggcttcagcacaaggaacagcaaggccaagcctgggtacgtgcagcctggagagtctggggggctgcaagggacccctgtggggtgggaggtggactgaggaggagctggtgccccaagcccaggcgaggttttggctttcgtgctgagcaagctgggggccgggatgtcccagcacaggagggacaggacctgagcaaggttttaagtcccccggggccatgtgtggagacccactgtgggagtgaaggggaaggcagggaaccctgggagaaggccactcagtgggccgggtatggtggagctggaccagggtggaggccagggagatgggacacggggccagagcaggaagaaagggtggcagcaggaaaaaagcatgagcacgcagggtctatgcgttggttgaatttttccttagaagactcaacctcagcataccccttatttgtcagatgtgggtcaccacctgccaatcacagtctcacgggcaggtcccgtgagccccctggagctgctgccctgggctgggcatgtggcctcagacctgggggtctggcagcaggagggggcacaggcagtggggagtgaccccaccccatgtggccacagcctcagcaggttactgcatctgggtctgtggtccttaaagtggggacagtgccctggcgagtcgttgggaagatgaagtgggcgctgtgagcagacagctgggtgtagggtgggcacagagtcaccatcagcagaaggctgctgggggaccaaggtagtgctctgccccgccctgggaggatgggctcctggagccaaggatcaccgagccttgcaggaagcccagacagctcaaggcccccatcgaccaatggctgatcaatactttgtcagctgaggcttcccggcaagggagtggctcccagcactgggcttttaggactagggctatgattggcagggacactggggacctggcttcctggatgtcctggctggtgggtggacacaggcctcctcaagtggctctgacaagcgtctcatcaattcaagcacagcaggtgggtgccaaaatctgcaggcaaatgagggcaggaccactgagcacagccacaggggacatgcccagggcaggtatttacacagtgagcacccactgggcattgctggtgtctgtcctgacttactgagtgttgggtgtgttgaacatgcctggcccttgcacacgcctgtgggctgcatttgagtctgggacatccagttgtgacccctgtggtaggccctccataaatacctgtggatttggtggggaggccagtcttggtgcaccatgggccctcacagctgctgcaggggtggatttcccagggccaccaagtatttcccttcccttgtctcctcctctgtgtcactccgcccctcctcctccctccttctctgatcaggcacaactgacacttgagcccctggaggtctggggattacggagtctcggcagacacatgttgggggctgaggaattacccagcagctgttgggcctcaggctgcagaggggatttactccagctcccagccccagggaaggatgaagccttctgacccccaacctggcagaggctacgcagagacagtacgtccactcctgggtgcaggggaagcagggaggtaacggaccccgtctccaccctgagggacatcccaggcccgcaactgtgagcattagtcagactgtggactgagtctggtcctcacactcaggtgagcgggaaactcatcacccccgtacttctctcccaattgaatgtctcattccctcattcccagcccccattccgggggagtgaggagggggcaacttcaacccacaccggggtacctcttcggggccatgtgatagttctgggatttggcaggtgactaaatgtgaagggagccaggacctccggggcctgtctcagcaggccctgagcctcacagcacaccagcgactcccctcttcctcacacacgccccttccctccagcagtaaaccatgccagcctgctgccatggtctgtttaggctgctatcacaaaataccataaatgggtgccttttaaacaacaggaatttctttttcacggttctggagaacatggagtccgtgatcaaggtgcctgcagattcagtactggagagggcttattctctggttcagaaaatgctgcctgcttgccatgtcctctcggatggtggaagggctgagccagctctctgggggctatttgatatgggtactcattccattcatgaatcctaatcacctccaaagctcccacttcctaataccttgggggttacgacttcaatatttgaatttggaagagacacaaaagttcagaccatagcatctgtcttctagtagaaccagaattcgcatacttctcgcctccttcattgctaccacacatccaagcctccttacctccctcctgaatactgcattggacccgtctctggtcttctgcagttcctcctccatattcagccagaagggccctgtgaaaacctgagacagctcctgttcctcctcctcacagcacttcttccctccaaagacagtccgtgcagttgtctacaaggccctgcctgatgcgaccctggttatgttttgcctcatttcccttacttccctctttctcaccttcttccagccacagcagcctcattgctgttcctcaaacacacctggcatcatctaacctcagggtctttgcacatgctgcttcctctacctgaaatgccctttctccagatgactagcccacatggctttctccctcaacaaatccagatcttttctcaaatgtcaccttatcagtgagcccttcccaattactcaatatataatttagacccacacaatcacacacatgcatgtgtgtcatgcacacacacacacacacacacacacacatcttattcctctcacctgcattctttttctcctttgtagttaccaccactcaacatgttatttatttacttaattactctgtttactgctggctccactgatagaatatcagccgcatgaggtcaacagctgtttgttcacagctgggtctgttgcacctggcattcaatacttttctgttgactggatggtggatggatggatggacggatggatggatgagtggatggatggatggatggatggatggatgggtgaatggatggatggatggatggatagatggatggatgatgagtggatggatggatgggtgaatgggtgggaaggtggatggatgaatggatggatggatgggtgaatgggtgggaaggtgggtggatgggtgggtgttggatggatagatcaatggtcgtgcattgctcctgtcaagctgatctggaggcccctgctccttctggggccggtatcaaacacagaaaccttagggagactgatctgggtcccctgtgtctaatgccccaggaaggtggccagagtccctgatgggtgtggtgtgtggctttgagtacagcaagggcctgggtggagttcaaggaggcaccaaggcccaggcagggaataactgcacctcgagtctaggtcaagctcagtcttgcaggcattttatgtttggcccacatggtgcttttaaaacggacttttagcaatacttaaaaatcaggagacttcatagaataacccctggtttcttgcaaaagcaaagaattaagtttcaaagggccttgcttccttcacataacaattagccagacctggggagtggccgtccctttacatggtaccttcctgccagttcactgccacccccaacgggcccgttcacccattatgtcctcgcctcgccccttcagacatgtgcgttcgcagcccctgcctggttggctgttggatccaagagaatggcagagagtgcccaccccacaaggtgcaggagctgtggggtattttcatgtgcccccaagtggcccagaagtagcagagagaacagctgggctaggagggctgtgggaccagcacaaggagcgtgtccaggatgcccacgatccaggctgcaagacgagtgtctcagcaagtgctgactcagagggatgtgacccaatgaccatgttagttctcactgtcacctggtaccaggtaaaccctccaaaaagggaaagggccaccctaaattgtctgaggtcaaacttccactacccatgcaacacagggactcaaacagaaataatagtgaacatggcaggcatagctatgtctaagtccttttatgagaaaatgtttttaaatgtcccagccacatgaagaaaacattctgttactgtcccatttcatagatgaggaaacacacgttcaagcccagcgtgttcaagtatacttggctaaggtcacagggctgggaggaagcaggtgcaaaccaggcattctggatccagaatctgtgcttcaaccagtttgcactaatgccaccaagatattgtgaagttttgcaacaaaaggtgcatttctgccacttcactggtggattgaggtgtggcttcacctcctctctaaacaggacccgtaaacaccaactgctttctggacctcttcaggctgaggctgccctgttgtacagacagtgaattggagggcatgtgcccatgtaaacagctgggctgtttggtgtgggggtgggcgggggcactgcagcctgacctttgctccagcctcttccttccttggggaagtggttaattggttcgccaggccagagggtcactcctagaagcccctgggacacgatcgatttctactcagaaagcctcagcctggaccagctgtcacttgtcagtgtcactggggagtcacgtgggctggagaagaaagtgccctgagctccatcctcagccacatgggctcaaactcccagtacagagactcccagcccagcctgccctcaaatagaaatgcttgttaacaggtcctgcactgctcagaaaagagtcataaaatactgtaacctagccagacaagttattttataaaggtcagtaaatgcccaaacatgctaaacagtgaaatgacagcaattcgaatcaaatgttatttattatatgataaaatgttttctatatgtacatctgtgagcatgaccacgctgaaatgaagccgtggggtgttcacacctaagcacaagaggacagtgaacatgggggtgcaaaggcagactgacacgcttggtgccgtaacctcacaacacaagaacacgacggtgggtgtgccgcaaggtggacaatcttccctcaatgtcaaaggttgatgccgtccttaaaaattcagcacatcttggctgggtgtggtggctcacacctgtaatcctggcactttgggaggccgaggtaggtggatcacctgaggtcaggagttcgagacagcctgaccaacatggcaaaaccccacctctgctaaaagtacgaaaattagccaggcgtggtggcgcatgcttgtaatcccagtacttgggaggcagaggtaggagaatcgaacccaggaggtggaggttgcagtgagtagagatcgcgccattgcactctagcctgggtgacaagagtgaaactccatctcaaaaaaaaaaaaaaaaaaaaaaaaattcagtgcatcttaaaatcacacggagaggataaaaagaaaaccctttgtggtgacacaacaatgtccaccatgtccctcctcctttcgaggacacgggttgattctgggcatgtcctctctcccctgcagctgtggctggaagtccagggcactgacgcccccagagtacggccctcactgcacgtggagggaggcgggtgtgcaatgcgccagcagccttgtggctcacggggacactgccgggcgcaggtcctggactgtttccccagtccccagcagtctgagctcccaatgcctgcagaggtgacgtgttgacacacccagtatctatggggatgccttcccttcccacacccactccagggttcctgggtcatgtcccaaatagacgacttgcccttgaatctgactcagggtctgcttctggggaggccaaactgagaccccaactgagcgagaatctaggtgtagagcctcaggaacgggtttcacctcctcgaatgtctggcaggacatgaaagcccggctggacccgacactggccctggttgcgaaggactttcccatgcaccaagggcacaatgtcagcaccccggccccgcccactgcttgtcagtgatgaccaagtatgttcccacaattcttagaacttgcccggggtcaggaccacccatcctgagaattcccacagctgatccctccagacaaggactgtgggatccacaacccggacagccgcctgggagctctggtctgtgtggaacagaggctgactgcccctgtcccttcccgtttccatctgtgcggccacctgtcctccctatttcaggcaggaggggaaactcctttgtctcccacctttgccctcactgtgatgcctcgggtgccttccttggagggtgcagtgcaccgttcagaggtcatgagcgctggcatgggcggaaccactcccagatgggttttatttcattcacggaaatggcccccaagtgtactgaaaagtggaatctgtagtcaaaatgtttaaataaggagactttacatttaaagaactgcatttccaatttctcttgagtaatcacaagttgtgggaacacaggtgacatttgcccttggtagggaatccctgagctgagctgcagctgcccctccacacagggcctgtgctccccactttgccacaatccccactcctccctgttgtccccactcctggcctgtttcactcactcacaccccctgccttgctcctgtgagtttgtgtccctgccagactggggactccacactgaggctgaggtcaccccactctctcccaacgttgcagagctgttacaaggacaaatgagatcatgagtataaagtgcctggaacgtagatgagcaatacaggtcagacaatcttaggattatggttactgtttataaagttatagagacggcacagtgtagggtcaggagggtaggctctgcagtatggctgcctggactcaaatccccactttgccatttcatctctgagtgaccttgggcaagttactaacctctctgccactcggttacctcatcagtaacctggatgatcaaaattgcaccaacttcctggggctgtgggggctgagtgagctcaggcacctcgagcgcccagaccccagctgcccacagtgaacgcatcgacaagcagcagctgcatgtgtgttagcactattgttcttcagcactccctacctcacctaagcccccacgaacttcggatgccacttcaggtcttcctcttccaagaggccctccctgaccatcacaggctatgagcacctcaggtaaacatgcttctgatcagcgcccagatctccccaagtcagcatgtcaggtgtgcgcctccacaacccataacaatcacaatggtgatgatggtgatggtggtgatgatgatgatgatgacgatgaatggttattgagtcctgaaaacaggccaggagttgcatttcactctctgagccacctcatttaactgaccaagggtgatgaggactcaggtgtcattcctgcacccaccaggcctcctgacaggagggaaggattaggacacacattccaagcacctgctgtgtaccaggcacatttatacaggttgactcccttaattctgtgggatctgcattaccattacccccattccacagaccagaaaactgaggctgggagcgtgaggtgaccggcctggggtcacacagccagtgagagacagagggtatcaggcactcaggtgtgtttggtgccaaataccaggctctgcccgtatctccatggggcgtttcctccaggtgtgagtgggaagaagattccacaaggctgctgccctgggtgggctgttggcacagagaacagggcaacagttggaggcagacgtctggggtcccttccctgcactctcataagctcccctggacacactccacatcaggatcctgggtcccctcggaggatgtctgctcacctccgggaggggaaaggagctgatgagaatggagggcccctccctgcagtgcccggaccccagccccagctcctcaaatcacagatggtggcactccagcaccttgaggatgcaagtaggaagggcatggggctctcgtttctctcctttcctctcatctctctctcctctccagtcctctcctcacctccactgctcagccctaggcccctgagtgttggaattaatgctgacctgtgccatgccaggtgtttccttgaattattccttggccttttggttgcaagaacccaaatcaaggactagaacaaaactaagaacaaagaaacaaaatgtctggtttgctgttccacattcacaagatggcttcaggcacagctgcatccaggggctcttacagtgtcacaagggtgcctcctcttggtctctcagccctgcttccctctgtgtcggtggagttctcagactggcccttcaggtagtggcaagggggtccccagcagccaggcttccatcctccaacttagcaccctcagcagaaactgggctctttcccagtgagtctggcacagccctggggtgacactcattggctcagatagagttatggatcttactggccagagccaggtcacatgacatccctgtgcagagaaggggcttgaaccacttggactgagagtgggaggagtttgcactgcgaccctgtggtgggtgtcagggtgcaggctgcggtatctgtggccacaacatcagtgttgggtccccagggatcagtcctgccagagatgctttcttgctgcctgcatagcctcctcatctgcttctttgtcctcccagaggttcaagagcccctggtgaccctgtaatccattcctttctctgctcaaaccagccagagtggagcctctggttgcaagaggagcgctgatactctcatggtaaagcctcattttacagatggggaggctgcgccccagggaggggaagtgactcccagtgtcacaggtcccatgagtggtggagacaggatttgaactggggacaccggacagctgcgcctgctccactccaggctgacgtggtctcctttctgcagggccagggccaggccctcagcaaggctgctggggagtcttggggacagagctgctgccctggctggggtggccttgcaggaggggcggggcctgctgtccttcctgggtaggctgagtcttgctctgtcctggccagttttaatagcctgagggcagaggggaggcaaaggtgaactctaatgagccattgatttctcaacaggaagccggctgtggccccagcgcatttcctcctaatggatgggaaagaaaatgtgaggacagcggtgccctggcgcggggccaccctcgggcacctcgctcattcccgctgtctgcaccttctgaggcccgaggtggacttttcgggaggcggcccagggtgagagagtctgtttgtcccattccagctctcacccccagcgtccagcagggtctggatcccgccatttgctcagacgttcaggctgcttctgtccagggacgggaccgtcactctgctgttcaaggcagacctgagagccacctggagtccctcagtgtggcttttccactctgacccaaggcaggccgcctctgcacacctgccctgtccacacttaggcagagcccccgtcacttctccctgggtcaccgcagatgcctctacccggggcctctgcagtttactgtccccatggcattgagaacactttaaacctgcaagtcgggccataatctctctgcctgctgcccccacggctccccacctgactcagaatgagtgccagcgccccggccttggccctagcctgtgccacatgactgccctttgtcctctgggtcctcccccaacctccccctgctctgtgacctgcagactgaccaggtggcccacaccacagggctcccttgcctctggctctggatgtgtccccccagtggggagtcccattgggaggtcagcaggggtggtgttggagttcacctggttccttttttggggggttgcctggggctggctgtgccctggcctcctttctatcctccactacaggaccgtctttcctgccccagggcctttgcactggctactcccattgcccggactgctccttaacccactcctccggcactcagtacacagtgcagccaagggctgcgtgaggaagtctgggggagggaggggcaggttgtgcaagagaaacaggagcttccctcaggccacatggacctggggcagaatggatctcagtggagatgtcaagctggtggctgtcactcagaacccagagcttcgaggaggggactgagctggaggcagatgtcaagggggtgtcttggttgatgtgtgtcctgcagtgtcaccttgtcagggacacctcttcacccctcccatctacagtgtgtgctcctgcttcccccatggatccctaaagcagcacattatattttcatcacacaatcctcatcatgcaatgatcattcttggtgattagtgttcagcactgcctttcgtcttccattttaactactgaatctcaagggtcgaacacaatcccagcctcataataaatgttcagtagtgtttggctaaataaaataatcagtgaatacacagtgtgcatttaacacacacatacattcatagccctgtcccacctgtacacactcacgcacctgtgtgcatgaacacgcccaccctaggatcctttcctgatggtgggattcttgtgtccaatgacgtgatacagctccctgggaggagcttcaaatggtgcccaccacagagccagtgcccatcttcactgccccgtggacacctgtgaattcgaaccagacatttacctagactctctctcccagcaggagcatcgccagacctctgtggatttgtgctttatccttgtttctctgctccgggtgtctggggaggatttatggaggaaacaacataatgagacctgagtgacttagagcttggggaggtcgaccacagcatcttcagagggaaggaaattcagatggcaatcgtcccagtggatgacttcacgtggtttccctggggaagccccgcccccagctgctccttcccgaggccctacctgcccttccaggcccagcccagtcctgcctctcccaggagtctcctctgagctcctgggtcacagggaagggtctcctcacagctcctgaggcagctctgcccgcccacccactggggttcatttctggccagagctcctccctcctccccagggcctcctgtggggtcctcagagagctgcttgtcccccaaagctgtccttggtgtcttcttagctgaggacggagtgttaaacacatcacagacaggaccatagtatcccacactacgccataaaaggagagttacaactttcaacctctgtaaatatttaaaagtaatgaaattatactccaagtcttataagacattaattgtatcaagggtctcttgtataaaaatatgcatgtatacattaacactataagtctctagaaccacagatatgacacaaaattaacataggtgctagaataaatattacaaggtttattcacactggcttagcttctctttctagagcttaggaggctgtttggggataatttatctatttcgactgtgccaaaagctggtgcaaagcctgggctttggggctgtgggtgtgcacacagctggggtcaaggggaggtttgatcttcagagctgagcaaccttgggaggaacacgagcccctctgctgtccgggtttcctcatctgtaaaatggaatcatcccaggattgtctggggctgcggtgaaatcacacatgtgaatcatgtgaacagtggactcaggaccgagtgacttctcattaaatcagaagctttcatcgtcactcgtttacacaaatacccccttcccccaaaagcatccccaaagccccaggctctgccaaactcccaggcaagggtggcttggtagatcgtcataaacagctaacatcataaaaatatgctcctagacacgttttttaaaagtgtgtattgaggccgggcacggtggctcacgcctataatcccagcactttgggaggccgaggcgggtggatcacgaggtcaggagatcgagaccatcctggctaacacggtgaaaccccgtctctactaaaaatacaaaaaaattagccgggcgtgatggtgggcgcctgtagtcccagctactcgggaggctgaggcaagagaatggcgtgaacccgggaggcggagcttgcagtgagccgagatagcgccactgcactccaacctgggcgaaagagcgactccgtctcaaaaaaaaaaaaaaaaaaaaaaaaaaaaaagtgtgtattgattacacaataggctccaatataatacaaagttacatagagcagattaaaaatacaactctctctgggccataaatttgacttaaaacttgcacataagctggaaaagacactaaacatttcattaatgcttatctgctgggcctcagaatttagctctgtggatgtgttgctttctgctgcgtgatccggttccctgtagacacgtctgtggcacccccgccccactttgatctgtgtttcgaaatttataatttacctcccacctcctgatgtggcgctttccgtctgctcaggactccagtgaggtcatccattcagtacgtattcattgagctcccactctgtgccaagcaagattccaggcatcggggcgtgaaacgctagaaaaaagacacagatgaaatatagtctaatcaggtgagataaagacaggaggcaggaggaaacgatgggaggagggagtgagggaggaaggacaagcgaatgccagtgaattgccggtttgctcatgcactgtcattagacctcacagcaaccctaccgtcagtgcaagtgccgttatgtgcgctattttacagatatggagactgaggcccagagaggttaaagtaactgcccagagacacccaagtaggaagtggtgggggcatgaattgaacccaggtccacctgaattcaaagcctctcacgggtctggaatgaaggaaggacggaatgaatgagtgaacgaatgaatgaattctggagtgaacgcatgagcaaatacatatcactgtcaagtccctgcacatcaggattccatgataactcttcaaacccaaggaagggtccaagcctctctctacctctccctctcccctactttctcattcccaagaattatttaggatccagatcaagaaacctggccctcttctgctcctctccccgctgcagatggcattttgcctggcctgctggggcagcccccaaaccgctctgcctgattccgccttcactttccccaggccattcttcacttactaacagaggactccttgaagacctgaggccgaccgtgccctcccctgctcagagcactccaggactcccacctcactcagaacaaaagccaaagtccttacagaggaccccaaggcccagtgagatttgcccaccactttctacaaccccagctccttccccttgccccctcgccctctcagccactgtggcctcctcgcccttcctctgccacaccagacactggctcgcccactgtgcagtcctggccttgttctttcctctgcctggaagttccttccccaggcatcctgctgtcagctcccccagttcttggcttaagtgtctcctcctctgtgaagctcaccctgactacctcatttctaatggcagcctcacccccacattttgtactttatttttctcttagcacttgtgaccatctgacatctgcttatgtatctcaatggctgtctgtctcttcctcaaatacaatgtcagctcaagagggcagggatttttattttccagtcctccctgtattctcccttcctagaatccctttcatatcagttaaaacaaaaatcaaacacctgccaggtgtggtggctcacgcctgtaattccagcacttcgagaggccgaggcgggcggatcacctgaggtcaggagttcgagaccagcctggccaacatggtgaaaccccgtctctactaaaaatacaaaaattagctgggagtggtggcacgtgcctgaatcccagctacctgggaggctgaggcaggagaattgcttgaacccaggaggcggaggttgcagtgggctgagatcgtgccattgtactcccgcctgggtgacaacagtgaaactctgtctcaaaaaaaaaaaaaaaaatcaaacaccaacagcaaaaacctttcctcagcatgttcttggtgcccacctaagggcctgcctctgtccaacatacactcatgggcatggtgtgtcaacgaggcccaggcttgctgaggacccaacgctaatggcatttgctaacggctccaggcctcacgtctctatgtttcacctaatttctgtgagcatcgtttctctacatgatcgacccacgcctcattctgtaagcccctcattgggataaactgggtcctcagaacctggaagttcattcaggcaatggaggtcttctgcatctcatctgtctgcagagttcccaggaccgggctgggaagacaggggttattgtgtgtcctgctcactctggacactgagcacacggagctggggctggtctaccgtgggtgctggctacatatttaggtttgaaagggtctaaaagagataaacagcagctgaggacaggtaccaggattgggtgcaggggagctgttggagctgagacatgaaggatgagacacagccaccagaagaagatgtgggaaacagcgagtgcctaggtctcggggcaggagtgagcaaggggagctggaagaacagcaaggaggcccctgtggttgagggagccaggggagagtctgagaggctgccaggggccaggttatgcaagatattggaagccatgaaagggagcttggattttcttccaagggcaatagggagccattgagaatttccgagcaggaggatcacatgatttgatttacatttttaaacgctcatttcagctgccgggatgagcatggatggagggaagcctgattggacagcagagaccacggatgaagctgctgtgactatccaggaggccaagatggatgaggggctctgtccagtgaggcatctggggggctcaggcacactttggagataggctcggcattcctgcttggctggatggactctacgttaaggcttaggaacagagcccctgctgacactgaggtatagccatgtctggtaattctcttgttcctgggacatattcactgagcgacctcacaggaaggagaggtggttggacctgtgccctctccaaaatgccaccacgacacagtcctaatggcccctaaactccagacttcccagatgcatccaatggggtatttgcccctgggccttcccgtggggtctcccttctccttctctgaggaagcttccacctggagtttgcagagggccataaagctcatgtttattctgctgatttatataaatgactttcctttcacaagcacgcccatcagcactgagcatgtccacattaattgggctggaggaggaaaattaagtgcttcaatttgccatttttcaagatgaaaaatgggaaaggagaaaatcactcaagtgagagggaaggagctgtgagtgttgaaacccacttcgaggagaggcagaggctgcgctgaggggaacagactcctgtagggagcagccctggacgaaggaaggaggtgatgaggtcagagcccacagcagccccagcagcccttcatggacctcaagtgtttaaacatagtaaagcacatttgctcctggctgtcctgtagggtagcatttcctgaaccctgagtcagatggggtcctaaagttgcaaggacagaaaatccaaccccaacagacttaagcaaaaagggaatagatagctttgggaggccgaggagggtggatcacttgaggttaggagttcaagaccagcttggtcaatgtggcaaaaccctgtctctaccaaaaatacaaaaattagcttggcatggtggtgtgcagctgtaatcccagctactcgggaggccaaggcaggagaatcgcttgaacctaggggtgggggctgcaatgagccaagatcatgtcattgcactccagcctgggttacagagtgagactccatctcaaaaaaaaaaaaaaaaaaaaaaaaaggaaaaggaataatggactcaaagaactgaaaagctttgagggttagtccagtgtcaggtagagcttgatctagggacccagacactttctcccacccctccagggctgctgtctcctcttcctttgcttgtggagagattccacctaccagctcagcagccccagggaaagaccttctcttcctggcggcccctgaggacttcgcaggattcacctgattggacgcgacttgccatgtgtccatctctgatctaaacactggggtcaaggtggcaggatttgctcacagccagggccactccctcaggtgacttggtacgagtaagaaagggatgccccttcctttcaggagaagcagcctgtgccaggacataagtctgtacctggtgattctgaatatgccagttcacagacctggatcttgtcccttgcatggagctgggtgtggggcccacccacctacagcacatgaaccaagagtggaggatggaggtttcccaaaggacaatcaaggtgctgtgcccaggaggcagagctcattcattcattgcctgtttagaaaatgcttactatgtgcagtgaagaaagagcttagagcctcgtttggggattgtcttcatctgttttctgctgttattacagaatactacagattgggtgatttaatagaaaagaggccaggcacagtagctcatacctgtagttccagcatgttgtggagcggacacaggtggatcacttgagctcagaactttgagaccaacctgggcaacatggaaaaaccctttctctacaaaaaaaaaaaaaaaaaaaaaaaaattagctgggtgtggtggcatgtgcctgtagtccgagctactcggaaggctgagatgggaggattgcctgagcctaggaggttgaggctgcagtgagccgagatcatgccactgcactccagcctgggcaacagagcaagaccctgtctcaagaagaaaaaaaagaaaaaagaaaagagatgtatttggctcacagatcaccactctggaggctgggaagtccaagactgaggggctgcctctggtgaggggcctacctgctgcatcagaacatggtggaaggcatcatacggtgaggaagcacacgcatgagacagagagaaaaaggggctggactctggcagtaactcagcctttctgtgataacagcatcaatccatttgtgagggcaaatccctcatgacctagtcacttcttaagggtctcacctcttaatactatcagaataacaattaaatttcttttttttttttttttttgagacaaggtctcactctgttgcccaggctggagtgcagtggcacaatctctactcactgtaactttgacctcctaggctcaagcaatcctcccacctcagggtcccaagtatcagggacccacaggtgtgtgccatcatgctcggccaattttttaactttttaaaagagacagggtctcactatattgcctaggttggtctggaactcctgggctcccacctggagctcctcccaccttggcctcccaaagtgctggaatcacaggcatgagccactgcacccagctggcaattaaatttcaacatgagttttgacagggatatccaaaacacagcaggggtatagacaaaaataatcaatgaacttattagttatataatattcacgacagcagtgttgtggagaaacgtaaagcaggacgggaggacagggcatgcagtgtcagatggggtggcctgggaggcctcacagacaaggtgacatttgagcaaaacttgaaggagataagtcctgtggatgtttcagaaaatagaaatcccagaagaaaagcaggtgcaaaggtcctggggccgaagatgagttggcccaagccagtgtgacggggcagatcctgcaggcccttgtgggccattagaaggaatttgacttctgctttatctgccatgaaaagcccctgggggttctgagaagaaaagagacatgatccgtgttctaatcgaattgctcagattgctgtatgagattagtttgtcatggggagggtggaagcaggaggtcagtgaggaggggactgcaattgtccaggagacaggggacatggctctggacttgggtggtggcaatggtaatgagaagcagttggatcctggatttaatcaggaagcagaccataaagggtttgtatcccgggtaggcaaaggtagcaaatggcccctacaagtggtgaactaactagatactgatcaaaagcaggcaatctctctgtttaaaggtgacccatttcctgtatactcgtctcctccctcatgtccctcaggtgtcatcagggagttccgtgctccttgtctagagccacctgactgtggatagctcagccaattgggtgggacctgtgtgatccatggaaagagatggatgttgtgagctgggtgctgaggctcctcgtggtaccctgaacccagagccatgctggaggcagggaagtggcacagctccgctcctcctggacaagatgcttagcagtccctggtccccagatgcagaggacagagccttcataaagcagccttctcttctgtggatcagcctggtcccaccttttaggtgacccaagggaaaactctgagctctgttaggattcttgcaaaaactcaattcaaacagacttaagtgaaacaagaaaacctcccagcccatgtaatgaagtcaggcgtattgggcttctgacccagctggctccagggctccaacaatctggccacgacgcagtctgtctccacttctgggctccgctgtcctctgtgttggcttcactcccaagtaggtagtctccacaggggaccatgacgaccgccggcagctcttggcttccatcccccagctcagcagtcccggagcacagagaacgtctctttcccagagtcagcaaagccccagggcatgctcccattggcccattgtggtcacatgtctgtgacaggccacagaacggcccccacgaaaggtgtccacgtcaaatacctggaacctgcggtgcccacgtagggcaaagatgtggctaagctaaggatcttgagacgaggacatgattctggattatttcgagtggaccctaaatactgtcatgggtccttattagagggaagaggagaagacagaggaggaggcaatgtggccacagtagcagagactggagcattgtggccacaagccaaggaatgcccgcagccacctgaagctggaaaaggcaaagaacagagaggcaaagtggggcaaagtccccaccccctgagcctccagagagagccgtggccaccctgacttcaggtttcccaccttagggctgtgagatgtgaatttctttgttgtgggctgcaccgtttgtggtaatttgtcatagtggccacaggaaacaatgtccctcccacttccaatcagagtccagtaggatggagcgttctgtatggtctccctggggtcacacatccccccagcccagtgctgggtcagccccacccggtccacaccacggctcagcatgaggctgaccaagtccataagggaaggtcaaaggtgggcgggaaggacacatccagacagaaatcatggatgctgccgtggctccttctcccagagcaggaaactgaatctgagaggtgggagatacttcaccagggtcatggagctcaaactggccaggaaaagctttcagcccagggcttcacgcccagctccagggcagggcatatccaatcttccatctgtaacaccctgagaagttcccaggaggcactgagtcatgggtgaggcctgtctcggggccataccccttgtctcaataagatcagcctcatatgtattccccaaaagcaatctgtgtaataaggagcagcccaggaggcccttctctccacacccctcattctccaagggcggctgacacccattagtgctccatcccccagtttggaaaacacaaatgtgcagcgtggaatgcaactcactgagcaggctgccctcctcctccccgactagactgagaggactgcagtggcatggggggtggtgctgggggaggaggaagtgggggagagtgggagggaccctgccaggagggctcagcttccctctgttctctgccagggccccgaggttcccctctatcatgctggggtgcaaattcacacatccccaccaatgtgcctgtgtgcatgcccaagcacacagccacagggacactggtagacatacacatgtgagcacaaacccacatgtgtgtgcaaagcctgtctacaacacatgcctgtacctgcacacacgtacactccaccacatacgtacacacgcagagcctttcccgccatctcacccacaggcgcacaccccctgaaacagctgaatgcaaatgccccactctctacacagaccccacagacacaggccacatcactcattccgagaccagacagcctgggtccaacccccagcttcaccacttctgaacctgtgatttgggtcacgtggtttaacccttgtgagcctcagtttcctccaacctaagaaataatctcagataaagccgtcatgggggttgcgtgagttaatgcacggaaagtgcttagaagaatggctggcaagcaacaggcatgagacaaatatgagccccaagcacacagccccagtgcatgtccacacgcttccacatatgcacacgtgggcacccacatgcatgcacctgcgtggatacctggcccaggcaccacacacggagatgaacattcacatgtgtacgaataggttaggcccccaaacagtgtactgtgcctgtgcatagtactcgtgcatcagcatccccacccacccacccacagatctgtgcccgtacgtatatgtccccacctgcacacacacccctcctgttctcagacatggccaactccttcatcccctccctcttggcccaatcacagtgtctttcagatctgggccttatcagaagccccagtcagaggaaggtggctactcctggctgagctcatgaaggacaggctcccctcatccagtcccaacaccatcactctgaggaactttctcggatgctctttgtggactcagagactcatggaacatttgtgctggaagggcccttacctgatcaggtctcgagttgtaaagatggggagactgtgccccagggaggggcacccccttgtccatggtcacccagggtgcaagtgcccagaacccacctggcagccactgggctgggtctccagaaggtgtcaagtgaaacttaacgggttgatgattggagtgactgggagacggtgctgtcccatcaatgcccccatgatgcggggaggaaattgaggctctgagaggctctcactcacccacccaggactcaaacccagctgcactactttctatttcaagaaagcatggcagggcctcccctgtccctgcaggctgtctggacatcggcaagagataggtggctgaggcagtgtgggtggtggggtgagaagccagggccatccccaggcctgggcattatgctggggacatcaccacacctgcagggccagaagtgagagcagcagtcggcctcaaatccaggtctgagagctggaatgagaccaaattacgcctgagcagggcttccccagggcaggaaggtggtggtgctggggtcaacggcaggccctgggggctcagatattttagctgagagtatgtgtgtactggtgtgcaaatgtgtgcgtgtggagggtataatgggctggtggggtcctgggttgtgttcgaaatgtctgtatgtgagtagggtacagatattgtatgaccaaccacagtgtgtgcacagggattgaatgaggcttctaatgttgacatgctttattttcctgtcgcataccattccctgcggcatttacttttccagacctgcacaatctccaaggctggtgaaatgccaccaactagatattcaccaaggcctgcctgatgccaggctcttggggaaagagaattaattctccttcactgttcactgtctgggtcaactcctcatggccaactgcacaagaaagaacaagggtctacagtctcctgccctgtttcctgcctccatctcctgcttaagcaccttctcaccccaagaatagatagccacaaggcatgaagctcaacagctccaaagagatttgagcaagcaggactgaagactccctatttcacatacatttcaataataatgataattaaatagctaccatttattgaggccgggcacagtggctcatgcctgtaatcccagcactttgggaggccaaggtgggtggatcactggaggtcaggagttcaagaccagcctggccaacatggtgaaaccctgtctctactaaaaatacaaaaattagcctggcatggtggcatgtgcctgtagtcccagctacttaggaggctgagtcaggagcatcgcttgaaccctggaggcagaagttgcagtgagctgaaatcgtgccactgcactccagcctgggtgacagagtgagattccatctcaaaaaagaaaagaaaagaaaagaaaagctaccattgattgagcgattaccacactctgggcactgttgcaactgccttagcatacctgacatcactcaacttctttgaagctccattcacctgtcattgttcccacccaccacttacagatgaggaaactgagacacaagggggtgagtgactggcccacgttgtgagaggtagaggcagggtttaaatttacacagaccgactccaggttaaaattatcttcaaattcttacgcaagagcccatgtttaagaacagccaaggagaccaggtgcggtggctcacgcctgtaatcccagcactttgggaggtggaggtgggcagatcacctgaggtcaggagttcgagaccagcttggccaacatgtcgaaaccccgtctctactaaaaatacaaaaattagtgaggtgtggtggcatacgcctgtaatcccagctactcaggaggctgaggcgggagaatcgcttgaacccaggaggcagaggttacagtgggccgagttgccaagcactccagcacgggcaacaaaagcagaaactccatctcaaaaaaaaaaaaagaacagccaaaaaaaaaacaagatggaatcaactaggggcgggaccactggtcttaagtgatttcagagccactgtaagcaaatccatacggtcctgatgttggaacaatcaaacagaaccaagcatagcaaaatataactccagaataaagtcccaggaaagatgaaacattaatattcttgccagacagtgggctatacgggggtgatgaagcagggtcctctcccttgaggggtgcccggtccaggcagacaagcctgtcaacggatcatctcaatatgggtgctatgtgctaatcgggtggtctgtggagtgttaaagcctggatgttaaaaactgcatcctccctgaggtcagggaccatggctgtatccttcaagtctagccatgggccatgcccacctggcactgaggacacatcggtggaagcacagcctggcgcagaaggagtcagtgtagaagacagactcctggattagtttctaactggaggacatggggaaagttattccacttctctgtgtctgttacttcatttttaagataaaaaatgctggtaaatagaatctgcctcaaatagctattagggtgtttaatgacataataaattgattattcctgctagagtagtaagaacaactccataaaaaccagtcattattataattgttgttgtttctaacattatcataaattaatgatcaggatatgactgccccagaataataacattgacttcttctggagcactggggactgggggccccatcctgagacaccatgatgcttttcccagcctgcttggcagacttcaacctattttgcagacaggagaatggaagtgaagtggctcgcgacccacagaggcagaggtggaaatgcaggaggtgaggaatgactttaacgcaacatcctgggagagacaggaagaaaaacacagaaaaagctcacagcgtggcctcctgcaggggcctccagcccagccatattggtggcacataagacttccaggggggcctgaatttgcacccttcaccctcgtttttctagagaagcagggaatgttgtcttggggatgaggaccagtcctttaagcagcttaaatccccatccctcacctgatgggcccacagggacaccacagtgtctactatgatctgttacctgcacaaggtcgtagtcttttcaggaagatgaatcaaatgacaggatttgcagtgagcagctctgtgtccaccagtggccaccacttctgcaccccaaggccaggtcaggtctcttcttcccagacctttctggaaaatgggctgcctggtctagagtgatgctccccatccccaccccaccatgtctgagatcccagctgtatcggtgtgttctcacgctgctaataaagacacacccgagactgggtaatttataaaggaaagaggtttaatggactcacagtttcacatggctggggaggcctgacaatcatggcggaaggcaaatgaggaacaaagtcacatcttacatggcagcaggcaagagggcatgtgcaggggaactcccctttacaaaaccatcagatctcgtgagacgtattcactgtcactaaaacagcatggaaaagacacatccccatgattcagttacctcccactgggtccctcccatgacatgtgagatttgggtggggacacagagccaaaccatatccccagcccctcctccacactgtacttcaggcctccccacccaccttgttctggttctctgagtccctgctttgccagattgttttaatcagatcttgcagataatgttttccacttatcaccatcttagctctcaacttatccttacagtcttggttaagaccctttttgtccaacatcttggacacttgccgtcaactcagatggggatgcttgcaggggagcaggttcagagtggggaatatcggagctcagttggggacatgctgtttgctgtgcccataaatcttcccagttggaggtttaattctggagaaacagagagagaatgcctggccttttggggaggcaggcgagcaccagcacctcccaaactcactgtgtcccaggccactgtggggtaggagaggagaggcttactgtataaccctcactctactgaagcttccctagagctgagcggcagtgcttccctcccctggcccgcctccttctcatctttactcttccactgtgtgtctgcaaactgcacagcttgttagtgagatacgctaataaaccaccatgtcatcacattagcagtttccagctgagaatctcccttcctgctcggggtggcagacacccaaacacagccccatcatcaggctgtttgcacagctaattacttttttccaacatggaggcgagagacttcctgaggcttccactcactcagaattgctgttgtggatttcagaatggtccccctgccaggcttgtctggatgtcccaaagactttagggagtagccagattctgccctctcattggatagaacgggaggccgaggtccacagaggggctgactgctcccattttgcagatgaggaaactcaggcacagagaggtagagtggtgatgcatccaaagcagctcatggctggggacaagaggccaggcctcctatttcccacaacagggctcttcctggggtccatcttacctcttcccagctaggtggagaggcctttctccccagtgtagcggggtggtcaaagaggaacaggactttgtgtgtggccactggcacttagagaggaagggctcacttcttgcctcatctactgagtcctgaccacccttgcaccctccccaggtcttcctttaggaggttctctttttccagggctctcccaggttgcctgtgggctgcacctcccaggtcacctcttgcttccccatagcccagtcttcttggctaacactctccccacgtgcttctgtagggctgcccacacacacctggggttgacaggtgtccagacctggccacctccaggcatgatgactgctcagacacaggcatgtgcccaggttggtccaatgcaaacatgctgggtgcctccactggaatgagggggaaagagaggcactctttccctagatccgctggctctgtgagagtgaagcaagcctagagcttggatgggcagagtggcatcactcagggagcctgcttgggaagccaccccaggtaagagcactacctgccatgacacttgggtagaaatgacagaaaactcactgaaatggcttaacagaaaaagagaactcatattacctcacataaagctccactccatcctggtactctgagagttttggcaggactctcccaccccaactctgggctcaccttgcctctctgtgagcttcactccggcctgatgttttcctggaggtggcagggaaggcctcccattgcggtcacccaagcagaaggaggacacatctttcccaacactcacgccaatgtcctggggttgactccatctgcaccagttcgagtcccctgtgcaaccctgagccaatcactgtagtcaagggaagaggatgacctgattggtcatatcttgatcatgtgatgactggggccaccaatgactttgcactgccttctgcccccatgattcaccaagagcaagtaggttgctaagcaaccagctccagctcttttgtggcacttgggactgggaaagccaccccagggtcctgcatgttgaattacagggaaagtcacaccagtgtcctgcatgttgaattacagggaaagtcacaccagggttctgcatgttgaattacagggaaagtcacacaggggtcctgcatgttgaattatagggaaagtcactccagggtcctgcatgttgaattacagggaaagtcacgccaaggtcctgcatgttgaattatcaggaaagtcacacagtggtcctgcatgttgaattacagggaaagtcacgccaaggtcctgaatgttgaattactcagtacttggatgtcagccggctgtggttccttggaggagaagacagcagggtgattttggttaatcttcccagtgacacttactcactaagagaccttgggcaaattactcccttctctcttatgtaaaatgaagataataataggacctgcttcagggggttgattgaggatcaaacggtgtaatttgtgatggtgacttggaagaatgcctcacccacagcggggctcagttaagagagctaactgtagctggtattgggagctccatgcccacatctggtcaaaaccacccccatccccctctacctctccctctcccagataaagagagggggcagatttctaatttggacatcagcccatgtcacctcctcactaaaagctctttaatgacacctcatggacttcaaggtcaagttcagggtcctcaccctggtctacaaggttctgcaggatctagccctccccagctcagtccagccacatggcccctttctcattttcaaacacaccaagctcaatccagcaaacagactttgcctcttgccattccctccgcctggagcagtcttctcccagctaccactgtgaaatggtttgattgtgtccccacccaaatctcatcttgaattatggctcccataattcccatgtgtcgtgggagggacctggcagaaggtaactgaatcatgggggtgggtctttcccatgctattcttatgatggtgaataagtctcacgagatctgatcgttttataaaggggaggtcccctgcacacgctttcttgcctgctgctgtctaagacgtgactttgctcttcttttgccttcttgcagtgattgtggggtctcccagccacgtggaactgtgagtccattaaacctctttcctttataaatgacccagtctcaggtatgtattagccatgagagaacagactaatacacactatcaataacaccctcaattcatacaggtctcttttcaaatgtcatctcctcagagaagccttccctgagcatttactctaagataaaccacttcctcccacttcctttctgtccccgtcagcctgatacacatttcattgtatcacttatgattatctgaaaatatgttagcctcctgtttgtgtttttatcacatgtaaaggatatttggggcttggagggtatagtctagacaaggtaagtcagaaaggaagaaagccaagtcctagggcacagactgagactgctcttactggatgatcaaaggcttctgttcaaagggaagctttgctggatcccagtgagccagttaatggtgtccctggacaccagaacaagttgctgcttgctagagtttgccaggtagtcctggctgctgcatcctctctcctgcatcttctggacagttctaggcgttggggagtgattggtgctaggtgagaagcagcctctgaataaacattcgggagtcagtgggggtcagtggtagttgagcatgtgggctttgaagtcagaactgggtttgaatccagtattagtccattcttacgctgctataaagacatacctgagactggataatttgtaaagaaaagaggtttaatcaactcacatttccataggctgtacatgaagcatggatgggagacctcaggaaacttatagtcatggtgagaagtgaggaggaagggagcacgtcctgcattgctggagcatgaggaaaagagagagatggaagggggaagtgctacacactttcaagaaaccagatctcatgagaactctatcaccagacagcactaggcgggtgttaaaccattagaaatcaccccattattcaatcacctcccaccaggttctcctccaacactgggatttacaagttgacatgagatttgggtagggacccagaacaaaactgtatcaaatcccaaactccacttccatagccaagaacttggtggttattgattgagggcctcctaggggccagccccttgctacatactttgcatgaactctcttgtctcatgtgtaagtaccacaggctaatgtctgcacctgtgcaccctctataatgatatctctcattttcatgattgagcagactgtaatggttgttgtgagcagaatagcggactctgagtgaagaaccttggcattcatgcctctaactgcagggaaatccttccactgcctaaagcctgccctcaggtctcctgtgaattcgctcaagctaccctcgagccccccaggccccatccatccactcaacaacatttacataggccaggcaaggcaccctgggggacagagacaagccagtcatatctgtgtccttgggaagctcaggtcaagggtgctttccccccactgttaacaaggttcttccctctccaggcctccgagcctccaactctcaaaaggtgcagctgtttattgccactgctcacatttacaccctgagacgaatataccattttacccaaaggacctcagaattggatgattttatttgcctaagaaatgctttacttgacttgtaatctagagatggcaaaatgtatagcttttgaatatgcatttagatctgttttgacaaatgcacaaacccctatcatgcaaactcttatcacaatataggacattgccctcatttcaaaacctcccttgcatcccatcttgtcaaccccacacaccaatccccagcagctgcctgttttctgattgcctttaccgtaaattaacatcgctagttctagatgttgtatcaaaagaatgtatagcatgcactcttgtgtctagcttcttttgcccaacatactgttgtaaaattaatccatacaattgtatgtcaatagtgcattccttttcataactacgtactaagtatcatttataaaagtgaacctcggctggacatggtggctcatgcctataatcccaacactttcggggctgaggcaggaggattgcttgaggccaggaaatcaggaccagcctaggcaatatattaagggcttatctctacaaaaatcttgttaaaagattacctacacatggtggcatgtgcctgtagtctcagctacttcagaggctgaggtgggaggatcgcttgagcccaagagcttgtggtaagctgggcaacagagtgaggccttgcctcaaaaacaaaaacaaaaaagtgcctcgatttgttcatccacgatctccccaatacctagagctatgtctagctgccttttttttttttttttttttttttttttttttttttttttgagacagggtctcaatctgtcacccaggctggagtgcagtagtgcaatcatggctcactgcaacctcaacccctagagctcaagtaatcctccccactcagcctcccgagtagcttggactacaggtatgagtcaccacatctgactagtttttaaatgctttgtagagacagggtctcaccattttgccctggctgctgctatggtttgaacggtggcatcccctccaaaattcacattgagacttagtccccattgcaacaatataagcagtgtggcttttgggaggagattaagtcatgagggctccccgctcatgaatggaataagcacccttataaaagggctcgcaattgaagggggcattctcgtgtctttcattgaggacacagtgttcctactctctgggccagccagacggcaacaaggcaccatcttggaagcagagagatgccttgagcagacaccagcgctgcagtgccttgaccttggacttctcagcctccagaactgtgagaaatacatttctattgtttataaattacccagtctgtggtatgctgtcctagctgcacaggcggactaagatactagcctacggtgaatgctcagaaatacttgttgcaggcatgaatccgggacatagcaaggacactgtttacaatgaggaagaaagacaaaggagaggaaatgagaacccagcctcactccttcttcaaaaattgtctcagtagtaaaaaggatgaaagctggctctccactcaacctgtcagacctctcttcagaaatgcaggggaagctgccacctggtgaataattcacctgcagtcagcagccccaaatgctgcattggcaaaaagcaaacagcctgcagaactgtttcttatttttaatctgctcagaaccagggtcttgaagcatttgcttttccatcctactaattttggaggcaattagctgttgggtgttcttgccgtcggctcccctctgtgtgtatgtccttgttaggtgtgctcaccctgcccaaacacaccagctgtgaagcgctttgttaatttactcttaaactaccattttaacaagcttcttaagtgatagaggcatttgtgcataaatagcaagtggtaagcttccccctggaacattaacctgatttattaaaaacactgtgactaccaagctttatacatcaacatctttaacacaaaaaaatatatgatctcatctcctcccacagccccagccctaatgtagacagagagctctgatgggaggtgagaacctggaagatgtcactgtgaaaggcgaaagaagccagttttttaatatttcaaatgcagccgagccagccaaccaaaacgtgttttctccgacattagcctggggacaagtggaaaaaaacagacacaatttctttccatgaccaaaccttcccacctagctgggccaaggatgaggtcaccctaacacctctctctgtgactctgatgggctggggggatgggctgagagtgggggaacaccccaacgaacttaaatttcaatgccctaaccgcaccccaccacctgccagaaactcagcatttcctaagcaccctccatgcacacactcctcatgaatgttgttttgggtcatctcactgcaccacctgtacaattatttcactaatgttatttttaaatggatcactttaaaaattttagcctcaaaccaaacaatattgtctgtgaaattgtagatttcatgcattagttatatatggtgtttctttaaaactttaaagatgaaatagtgaaatagataatgcactctggtgtaccatgtactattggtgtgacacataacacaccagggaaatgctgaattaattccatattccaaagttcagagcaaacaatgtttcctgggacttagacggtgtctaatactttgaagattcaaagttaagcttagttttccagtccagaggcttctgtgcaagagactacatccatcagccagcagcagacgcacactgcatctgaccgaatacctgcttcccttctcctgagaagtacaggagcaccgtgtggggtggataatgaaggagatgatgtcctggtgtgtgtgtgtgtgtgtgtgtgtgtgtgtgtgtgtgtgtgtggtttagttataggtgaataattagattacgtgatttcaggaactctttgggaaatagaagaagggtggcacagtgagaagaatgaagctggggtcagtaaatgcagggtcttgacttcagtctgtgtctaaccattgccatctcttgcctggactattgtagtctcctaactggtcttccagcttcaccctcggccaccaccctgtgttctccattcagagccagggtgggcctttcagcccaagtcagctcatcacattccatcactcagagtcctctagggacccaccctctcatgcaaaataaaagccaaagtcttccccatggcctgcaaggccctccatggcctgacccctcatcctctcttcaacctccacccctgccactccccacctcactcccctgctgcagccacatgggcctctgtgctgctcccccagccccttgagaaccctcctgcctcagggtctttgcacttgcgggtccctctgccaaggctgctcttccccagatatctgcctggctcatcctctcactccaggctctgcagatgtcacctcctccaagaggccctctctggtgccaccttctaaagagcaccctgttgctgcgtaatgactcagtttaccctatgctttttctcaatatgcatatatatgtctaatatctatgcgtcattgagtaaatgaggggaaaatgttctcagaggatgcagaagaacctgagcatgatactggcctgtgttagcggtgggtggggaatgaagcgctttgtgttatttaaatctttaaagaacaactgtattactcatgtaatgaagaatattgggggacgagtcagagaggggaaagaaaacagcctagaaacaagtaaatctgggtaagaaccaagatgagcaaggacttcctccctcctccatgcctcacccccgaggagcagcacattccatatggcagagcctgagatgctcacgtggaggctctgggcaaggactcgcctctctctgcagcaaccacaagtgactctgaatataaaacaaggtcacaggtgactcacagatccaaagaagtgttttgctgggtctctatggtgctttaaaaattagatgtcacccaaacatctggatttctgctttctcttagacaaatgagtagccacagccactgagaagtagcaatgctcttcaaatggggcctgggctccccgcttcgccatagcccccacctctccccactgccttctcagccccgagactgagtcaaagtcacctttgttattacactcagcttgctgcattccttcttgtaaagttcagagggagtcggagtatttattgtactcatgtctttataaaaaaatgggaaactaagaggaccacgtggttctagattttttagaattctggaagaccaggagttttctgcttgggctgcctgagtgactctgagccaagcctctccaggcctgtgagtctgccactgttaggtcaaccagccaggatgctaatggggatgaagtcagcacaagctagttttctactggtggcccagaaacccaggagacactctcagctttggcccagaattcatctgccacatttttccttgatgtgctccaactttgcggggggttccttgggcctaggattcctacaccgtgttttctcctctctcttggattaaggagcaggatctcaggggcaacctggcatggggcaggcagagaaagaagaaagcacagctcgaggcctgcttctttccaagcatttcctttcttacccgtgttctttagtttcctcttaagggttgaactgtttgcttactctgtctgtctctttcttgcttgtttgctattgctccatcttcatctctatctcggtctctcatatagagagagaaacaggctcgcaactgaaccaccagccccaccctcatctttgtacttgcagcgtgccagagcactggattaagagtctgaaaaataaggcaggacacacacaccccagcccccaaccactagccatttccacagtcttcaataagccacgtacttctcatctacaaatgtatatgtcataggttactttaggtctaacatttaactatacatttctaggataattccagaatattctaagtcaccaaacctaggtcagtggagaggtcagggcatgggcgctcaaattagaagtcccgggcttgaatcctgacttgctactctctttgggacctgtgcaaaggactcaaccaccctgtgcctcagttgcctcatctgtaatatggggagaataacaacatcaccccttctgaggttgttctaaatattgtgaaagaggcagaattttacctccacccggtttttagctgggcctgagaatgaaattgacataagactgatcaacagaagaaacacacacacatttactctatttaattcaagttttacatggtacagaagacccaaagatacaattagttaaatacttatatttcgtattggacaaagagcagtaattggtagaagagcaactaaattatgtgggaggctaaaaaaaaattattataacaaggtctgtagggaattctctaatctcaacttgcagcccttgttgataagaatgtgactttccagctgggcgtggtggctcacgcctgtaatcccagcactttgggaggctgaggtgggtggatcacaaggtcaggagatggagaccatcctggctaacagggtgaaaccccatctctactaaaaatacaaaaaattagtggggtgtggtggcgggcgcctgtagtcccagctactcgggaggctgaggcaggggaatggcgcgaacccgggaggcagagcttgcagtgagccgagatcgcaccactgcactccagcctgggtgacagagtgagactccgtctcaaaaaaaaaaaaaaaaaaaaaaaagaatgttactttccttctagggatatagggagggcatcgctcacataggaatttcacctcctacttttacaaaacagaatgaaggtcaggatgatcttcttgtgcctgctgtgttggaagcacctgtaattcaaaatagccaacatgccagagcagcatatttcaaggcagcatattcttaactgcttcgataccaattcagaaaatacacataaagcctatgcatagtgcaacgctgtgcatagcaagcacttaatatatgttagccttctagaagtttacatcttgtagttcacacatatagtgcaacaatataacagtctgccatcgggatcctttctacagatgagtttgttttgggtccttcccccaagatgttaacaaatttttttctttaattagctaccaacttcttttttattttatttatatatttttgagacagagtctcactcagatgcccaggctggattgcagtggcgtaatctcagctcactgcaatctctgcctcccctgttcaggcgattctcgtacctcagcctcctgagtagctggaattaaaggcacgtgccaccacaccaggctaatttttgtatttttagtagagatggggtttcgccatgttggccaggctggtctcgaactcctgccttcaggtgatccacaagcttcagcctgcaaaaatgttggcatgagccaccatgcctggccccaacttcctttctaattgggagattttacttttggctatgctcaaagagttggaagacctgctcatactgtttccctttccacatggggagtgtgtagtgagggctgctttctagactgagcacatcctcacctgtccaccataatcccctccacacccaattctctaattgacattaaccccactcccagcccctgtagatgctgagtttgcaacctctggctccagctcaagagatgagataaataaacctgcaaatagaactttcgagtgtggcacagagagaagttccaaaacaagcctgcaggtgttcataggagaagaggggctgcaggtctggcgtggtgagaggtggtctcaggtagaggctggggatagactatgaagtggaaaggcaggggtgaggggcagtgagcacctgtggggaagcaggaaagcacctgtgtcctgcaccatcctcctgccctgttgtcctcctgccaagctagaattcactcagcagcgcttgcccagcctcaggtgtccctagaacatccacagtccatgggatcggcttctgagctgtccacggtgcccatggccacacctgcttaccagccgcagcagactgggccccatcaggcctgaccacccaccccagaatagcactgtccccagcaggggttttgagaaagggctgggggacaaacaacagcaatcagaaaccacatctgggcagagcaaatccattgttttccacacagtaacgtgctcactgatgtggtggcaactcttggtgttcctgtaactcaatccagaatgaggacactggattcccaggacccacttatcagatgaggcttcctcccaacagtgccaaggcaaaccattcctgactctcagttattaccaaatcaagtcaaatgtcattgctagttttagctccaaaaagccaaggctcaaaattggttcctaaactcaaaatcaattaagcagatgtcgaagagggggaattgaatttcattaatgaacattggactgaaaaatcgtactgtgaattttttctcctccaccttctgctggctgtagttgtagaagcttctgggagaaaattctgatatggtcattgtcactggaagggagatggcagcaggccccagggaaagggcaggacacaaaggacacaggtataatcaatgggactctgaagccattgctcatctcctctctgagaagctccacccagaaactgtcctttcctgacgattttacttgtgatccaataacgctttgtccttggcagcaggttttctgttcaacaaggcatggcctataaggtgtgtttccaagtttggggagttggccagatagagccagtaaaccagccactggcctagggggcaacgtctgcaaagcagcttaatatccacccttccccacctctcccaatctgttcttcctccacctgccttcccatctctgtaaatggcaccaccatctgcccaacagctcagccaacatccaggagtcatccccgattcctcttccctcacctgcccacctgagatccatcagcaagccctgccgatcttccaagcagcaccgcaatccactcacctctctccctctgcagcgccccgtctgctccgcgccatcagcctctcccacctggcccactgcaaacaccacctgatctccctgcttccactcttgtccctgggccaccctcttcacccagggggtgggcctttaagaacatgaagggcatatccttcacttacttagaatgcatcaatggcctttcatcgttcttagaattaaatccaagccctcttgcaaggcctcctggtcctccatgatcagcctttgttgctcctctgttctcatctcccatcccttgctacacacgctcagaggctcagaggcgtgtgtgcctggggagcagtgattgatcaggccctgatcacgaagtcagtgtgtggccttcaatataatagatggagatgttctcattcaacaaaattctgaatggcaaataattttttttttgcttttaatctagtttggtgggggcacacttgaaatgcaacagtctgggatattctctaaaaagcacctgatttctacctggtgtggaccctcagggcaatgagcagtggcgactccacccctgatgttccggggtttgaggattgactgtatccttaagcctcagacacaagagccactgactgccacatagcactccttaaatgtcataagcatggccccaacattaaatgcctgggactcactcttggcaatgtttttcccttttccagcctccatccttaacagtcagggagaaagtctcaggggctcattgccttgaacgcctctctcctactcacgctcggaaataggcacttacaaaccaccgtgaaggcagcaatgtgctgaagtttaataactgcactgtgcttggttttacaatggcctcttacttacgtcagtggatattgctttcctattcacagtccaaaattactcaaccatagaaatacaaacctcaggtaattctacagatggcattgcgttattgaaaaatggtgcaactgtatgtgcatagctgatattgggaacccctgagctacagcggttgctcctcaaggcaagaaccatgaattgccatctgggtgccccagagcctggccaaatcctgacctccaaagaggctcaccaaaggtttgtttgggttgaattaagccagtcacacctgttcacagtgtatttctaaaaaatccattcctgccatagactttctagccaaaggacaccgttcagacaaggtcccgttttcactgcgtttctctccccgtagagaaagggagaatctatacaaggtaccactctccacctgtaccccacaatttggaaacagaatgggcttctcaccttgctgtgtccagcccgagtcctcccaaccagatgcaagttagggttgtgaaagttgtcagaatcaaaatggagtcactggtgtttaaaaaacaaaccaacaaaaaacctggacaaatagagctggggaaggccgtgaagagagggttctcaggcttgtatgcctgataacaaaaccatcacaaaagactgtgaaaaccacaaccttgcaaaaaggtcaccgcagccttacacaaaaaatacttctgcaaggacatctgcctagaaactgcctgtccaaccttggactgaggtcacccttgttattggtctttgcagtcaaggataattatttcaaaacaattctttaatctttctcatttttccctctaaaaacctctgtctgcctttacctccctgaattcgcacatcgtttacaatggcatccatattctcattgcaaggcttgattcctgaatatgtatcttttccttttagagaacttctctctgtaatttaggttgacagggtggacacctatacaccctctctaggacagggaggaaccctgggattatcttggtggagaaatctccagcacagagaactgtcagaacagttgcatggatgagcagaaaagagcagatgctaagtttttccctgacccccactgctgcatgtcggctgtaattggatgcaagaaaatgtgttaacttttttgtggacaagcatcattgacctgggttgaaccagacatacagaaggcccatcccccttctcatccaccatctcttggaaggagcttggtcaccttcaaaggccagtttcttagttggagaggaaggtctagttctttgcagaaagaacacacactgtgtgtgtgtgtgtgtgtgtgtgtgtgtgtgtgtgtgtgtgtgtgtgtgtgtgtgtgtctgtctgtctgtctgtcggtctgtcttgctttctgtaaagaactaaggctccttggtgctgatctagtagggagagtcaccaggggtggaagctgacagaggccacagatgccagggactctcagaccactgcatccactccctggcattcatctccagaaacactcactcagggtgcaaggtgcatgtagaaagacatctagcaacattatttataacagtgaaaaatgaactttcaaatgggaacaattcaatgtcttctcccagagactggctaaatagcacagtcattaaggacctgggctctgagttcaaatcttgtttcttccgcttacaatatatgcataccatatacacacataaattcacctacacatctacctatcgtacgtcataaacacacattcgtagagtctccactttctatggccttcctagctctgccctcccctgtgtcttcatctcacctgtagcttcctttctgatgccagcatattctgttggttttcatcaagattcatcaatacaaaattataatccaggcctaacatttagctgacttcaaccaaggattctacagtaagcatttattgatcccaagtgagaagttctggggttcaattaccaacctggtggttcaggtgaaaagcctggaaaccttccccttccctttccccttgacctcagtccccattctccctggagtggggcagtggccccagctctacacaagccccttcatcatctctctcctgattatcacactggctttctctacagtctctgggcttctaccgttgcccctgactgcctgtcatccacatgaagccagagggtcttactgggacctaagtcacatcatgcctctcctctgcttaaagccacctgatccacatccctaggaaaaaacccaaaccctcaccacagcctatgaggccccatataacatagcccttcccgacttctctaagctcaagtccaccttgcaaagttctgcctagaaacaagactcccttaacagtatccacaatctggaaatgcccatccgtggcccatgcgacccattctaaatgccaccatattcccatgtgtcaaatcgtcaacgcaagccctgggctctgtttgctgcctggatgaaaattctttttgaaaactgcctgaaaatcatctatatgcctgatgattaatgcacactgttacacgaggagcaacttggtttcatccaaattatctattcttggcaacgaaaagactgattcatgtttctaataatgaattccaaaaggctacagatttgcaattggatcatcaccaatttaagagtcgatggcaattggatcatcaccaatttaagagttgattgcaaagtcttgccttgaagatctttatatttgcttctagcaacaatgttccaaactctgttgtcctttgacagtggacagaggcttaggcccacccctaacctgatcaatggctggcacttcttagcagaacccttgagagcctccaggatccgtatcccaccttgctctccagtctcaggtcctgctgcccttccccagggtcactatgctccagccacacctgccgcaggccctttgcacatgcaaagctggtccctctggaatctgccttttaggcagtggtgtgacaggagcatctaaattccatttagcagacagaaaatagtgtggaggagataaagaagccaagcaaagaagaaggctgggagagagggagtgtgtttggtgatctgttgcttctttcaggatgcaggattcgtgcttcatgcttttatttttttcctcttgcctctaaattcacagatctgaaggaaaagaattaagtggatatttacacaaaggcagacccgatgccagctcacagatactgatctgtataatgtctcctggcatgaacaatgagagcgtttctttgaacagcagaagctatagcagagcaaaaacttaactgtgttgaagtcaaaagaaaaatatttgcaatttgctcagccaatagaccggcaggaaagccctttgagaccgcttctgcagatagaatttctcccatgggcccagctgagtgtgttggtggcagcccaggacccgagtcagataatcagcctgtctgtaaacaatccttccaattcaacagacaacctgtccccagggaaagggacagccgcagcccaatctgagggagtgaacatttctggtcttctcctatctgccagcacactgggctgcagaggtgggtgagaggaagttccagctctcaagccatgggggactcaatgagggctttgttttgttgttgttgttgttgttgttgctgctgttttgagacagagtctcactctgtcgcccaggctggagtgcagtggcacaatcttggctcactgcaacctccacctcccaggttcaagccatcctcccacctcagcctcccaagtagctaggattacaagtgtgtaccacccatgcccggctaatttttgtattttttttttgtagaggtaggatttcaccatgtttgccaggctggtctcaaactcctgacctcaagtgatctgccctcctcggcctctcaaagcgctgggattacaggcgtgagccactatgtctggcctcagtgaggggtttaaaccagctgggggctggtgctttgagctgtttcagtcccagatcctccactcactagctcagtttccccatgaaccagccagtgaggaacctctgtttcttccactatgaaatggggaaatgggactgctataagaactcagtctaatagggatgtgtgtgaaagcctcttgtcaaaggatcccataacaaaaattattcatgttagttttaaatggcaaaataaacaaaatgataaaaaaaaaaaaagagagagagagagagagagaacattccactgtgatgcctgaaccataagaaagggtgggtgagggaggccgggacaaccaacctccctctgctctttgctctctatggtaatttttctagtttttgggcgaagtgagccttcaggtcctgcgcagatatagacttttggtggcaatttgttttaaatgagagagagaggcgttgtgagcaagcagggccttggctgcgtcactgtcgctgtggccttgaaagagcctgtttgttgctgccatctgtgggggaacccggacaccaccccaaagtcatgatgcaaggactcagagaggactccagtttcttcagggggggatgggctgactgtggtatctctcctgggaactgtaacagcagcctgaggggtctccccatgtccccttgcccccatcttccattctcctccgatagctggaggcctcttcctaaagtggcaaatcacatcacagcacttagcaaggctggcactgggggagagcagtgaagagcaggggggaccaaagtgaaggagacctcgctcccagattgtgtaagtgccaggcactcactttgccttaggtccagtccggtactcacctgctcatacctccccggcttctcaaggctctcagaataaaatgcaaactccctgccagagccatccggggaagtgatacctggtccctgcccacccctctcctgcttctcaattcccctccagtcccaccagcttctttctgttgctgggacgactcaaactttatcctgcccagaaggaaaaaagtgttttcctgtatttttcctgtatacgcacaatacttctgataccaaatatatgggttttccgctggcattcagcaattcttcagctccctggtcaccaactgggcatcctacaatttaattctggcactaactacctacagtgagtgcagacccacagggtaagggctcagtcccacaagactgccccctacttcagacaccagccacaagtcctggattgtgatccacgcttctgaccaaaaggctgtaaatcaggagtttccacgacccactcctttcaataatttgctaggacagctcacaacactggtttattatgaagggaatcacgaaggatacagatgaacaaacagatggagagacaaccggggcaagtgtagatagaggcccagaacttgcttgtcttctcccaggtgccacccttctagcacctggatgtcgtcaccaaccaggaagctcttggaatcccattgattagggtttgtatggaggcttcattatgtagccataattgactaattcatcgaccttcagtgattagtcaatttccagtccctttcttggaccctagaggttgggggggatggaactctcctggttggatcctccggcaaccaatccccattctccaagggtaacctcattagcataaagtcaggtatggttgaaaggagcttattatgaaaaacaaaagatactcctctcacctctatcacttaggaaattccaagggtttaagacctctgtgacaggaacctggagaaagactaaatatacatttcttaatataatatatgtcagtatcattgcaccagggtctttgcactttttcttccttatccctggaatagtttttccccagattttgtatgatgagctccttcttctgtactaaatcttagcacaaatgtcacctcctcagagagtcctgccctggctaccctacctaagatgatgcctctaacccaggcactctctgtattttatatcctgtttcatttctctcttagtccttactgcagcctacaattatttagtacctgtcacccccactggaaggtcagctccaccagggcagagactgggtctgggttgtgcacagctctctccccagcaccttgtccagcacttggcacatagtaggcaccaactaaatatttagataattaaaggaatggagattctgttaaggtcctttcagttctgcagtgagggaggctcagctcggcagggctgggccataacccaggtctacacggctcagaggcctctatcactgacacccttccccagccaccctccatgggtcaccaaggagtagctgacctctctgagttttctgtgccagaagctctagcagcaggggtgctatttggaagaccatgacaatggccctagggtatgatgctctgtttctcccacctccatctcttttccatatttttggctctgccctagcattaagatagccagtcacccagtctccccaggcctgtgctttctgctgtgtttggccaataagagcagagaggggcagtagcctcccaccctccttgctgggtcctgatgcagctgtggctgttgctatggtttgaatatttgccccatccaaaactcacattaaaattttatctccaatgtgacagacagtattgacaggtggggcctctaagaggtgattgggtcatgaaggctctgcccttgtgaatggattaatcccttcattgatcatgtgagtgtgactgatggttttataagaagaggtaaagagatcagagctagcacattagtttgttcagttctccatcccccatgtgatgccctgcatacctcaggactatgcagagagtccccaccagcaagaaggccctcaccagacacagcaccttgaccttggacttctcagtttccattattataagaaagaaattctttttctttataaattacccagtttcaggtattctgatataagtataaagcaaaaataaaatccaaagcttctccaaccaactgaacagacccactctgggccaaggggaccctagagaaacctgaaaaactgaattcctggccattggaaaaagaggttgaacataccccattatactcgctgccttttggagtttaggcacaattgactagcattaacattaaaatagagatcataaaactgacaaaacagactctttgtgaaaaaaagaccaaattcaaagcctgactctagtatagcatcacatgacagatagcaaactctgaaggaaatcaaaatattttaccccaaaatatatttcattgacatattttgagatggccttgcaaggctgtcttttgtgggggagatttgtatgtgtagagtatctccagaaatgcagccaggcttttcaaggatctaggagagattaactaagagtctgacacattttaaggtccaaaaagtgatatttaccatctattctctctgaagcccattacctggaggcttcatctacataacaagaaccttggcttccacaaacccctctcatctttttttttttttttttttttgagatgtctcgctctgtcgcctgggctggagtgcagtggcctgatcttggctcactgcaacctccactttccagttcaagcaattctcctgcctcagccactcaagtatctgggattacaggtgcccattaccatgcccagataatttttgtaattttagtagatacagtgtttcaacatgttggtcaggctggtcttgaactcctgacctcaagcaatcctcctgcctcagcctcctaaagtgctgggattacaggcataagccaccgcacctggcccctcctcttatcttaactcaagcatttctttctactgactttaagtgtttagacaaagcctaactttttcaactaattgccaatcagaaaatctttgaatccacctgtgacctgtaagtcctccctccccttcaagatgtccccacccttccaggccaatgtataccttacatgtattgatttatgtctttgtctgtaacttctgtctccctaaagtatataaaaccaaactgtcaccttactgccttggacacactttctcaggacctgttgagaccgttctccaggccatggtcacttatatggactcagaataaacctttttaaatattgtaccgagtttttttcttttaacataagcaacagaaaatggacgaagacagcagtgttcctcttcctgtggtctcagcatctcatgggcaatcctctcttacagctgcagttctcacaagctctagtaactcccttgctcccagcgcctccagtcccagggctggtaagggttcccatctgtttctagtccctggggttctgggaaaagtacttaacccctctgtgcctcacaatcctcatctacataacaagaacgataatggcacctacctcactgagccattggaacaattaaatgagataatatgaggtagtgcctagaatagtacctggtatataataagcatgattattattgttgttattattttattaccattattggctattgctgttattattttattactgccatttcctgtgttaagcactaatctcatagtatctcattggatcctcttattatttcaattttacacttgaggcaacggcagcttaggcaaacccagccagttttccagcatgatccagttagaacatagcagaatcaggcctcaagttttcgtctgactgctcagcctaagatcttgaccaccaagacaggtttccccctgcccctttatctattcaaagtccatagttgcgtgagggggctggcctgtgcattgcaggatgtttacctatatccatggcctctatccactagatgccagccatccacaacaaagaaagatctaaccaaaaatgtcagtagggacaaggttgagagatcctggtatgacgcttatgcagatacaagaaaagccataattatggaggtaagtgctctacatttgactcaaactgatgaaatgatgacatcagtagactaatttacatgtatacctagaataaccactaaaaaagctacctggagagatacacttaaaaataccatagatatatcaaaccagaactctaaaaaatattcaaataactcacaggaagaccacaaaaaaagaaaggaaaataaaacagaaaaattaaaaccagaagaagcaaacaaaaaataaaatggcagacttaagccctagtatggtaacgacattaaatgttgatagttgtattagtctcttctcacattgctataaagaaatacctgagacagggtaatttattttaaaaaggggtttaattggcctacagctctgcaggctgtacaggaagcatgggtgggaaggcctcagggagcttttactcatggcagaatgcgaagccagagaaagcatcttacgtggctggagcaggaggaagcggggtggggagatgctacacactttgaaacaacaagatctcatgagaactcactcactatacagtaccaaggtgtatggtgctgaaccactcatgagaactccatccccatgatccaatcacctcccaccaggccccacctccaacactggggattacaatacaagatgagatttggatgcggacacagacccaaaccctatcaatgatctaattaaaacaaaagattggcagagtgagtttaaaacatgacccaattatatgttgtcacaagaaactcacctcaaatgtaactagataggcagtaacaaaccaggagcagaattcttgaaattccagaaagaaaacaagaatattgtgaatggataaaaatagggtaaacataaacgattttactagttttcacctcatgagtttcttatattatatgtgttggttgaaacaaaaataataacatcatgtgatgtgattctcaatgtatgaaagcaacacttaagacaattatattgtaaaagcgtgaaggggaaagggacctaagtagcaggaaggcctggatgcttcaggctaagtgttgaaacagtgatagcagtatttacaataaactgtgtatgtatataggcagccactgagcaaaatatacaaagcaatatactctaatacataaataaatcaaaatggaattctaaaaatcattcagaaacccacaggaaggcaagaaaagagaaacagagggtaaacagagaaaataaataataaaatctcagttcttagctctaacatatccgtaattacttcaaatgtcaatggtctaactgtactgattaagagagagagtggattgagaaatacaagtcaggtacatctgcatacaagaaactcacttcaaatataatgacacataagctgaaacctaaagaatggataaagttgtatcatgggccaggtccagcggctcatgcctgtaatcccagcactttgggaggccaaggtgggtggatcatctgaggtcaggagttcaaaaccagcctggccaacatggtaaaacccggtctctactaaaaacagaaaaaattagctgggtgtggtggtgcatgcctgtaatcccagctacttgggaggctgaggcagcagaattgcttgagcctggaaggtggaggttgcagtgagctgagttcgagccattgcacactagcctaggcaacaagagtgaaacgccatctcaaaaaaaaaaaaaaaagttgtatcatgcggatattgatttaataaaatggagtgtttatattaatattagattaaatagactttagagcaaagacattagtagggtcaataagagacattacataagtataaaaggatcaatccatagagaagaatagtgatcctaaatgtgtatgcaccaaccaatggagctttgaaatacatgaaacaaaaactgatagagctgaaaggagaaatagataaatccacaattacaactggagatgtcaggacctaagatatcagcatttgacattttctatcagtaattgacacatctagtagacagatctaacaggaaggaaatcagtaaggatacagttaaactgaacaatatcataaatcaactggatctaattgacatgtatagtttacttcatccaacaacaacagaaatgtacattcttcctaagcttacatgggacattcaccaaggtagattgtctcctggtttataaagtagagtttaacaaagtttaaaaaattgaaaccacaaagagaacactctcttaccataatgaaataaactagaaatcaataatagaaagacaacaggaaaatcttcaaatgtatgactattaaacagctcaattctacataacccatgagtaaaagaagaagtctccaagaaaataaaaaaaaatacatagaactgaatgataatgaaaatacgacatatcaaaatgtgtgagatgtagttaaagtcatgctgagaaataactttggagtactaagtgcctacattagaaaaaaaggaaaaagctcaaatcaataatccaagtcctacctcaagaaagtaggtaaaaagagtaaagtaaacccaaagtgagcagaaagaaggaaataataaagataagaacagaaacgaatgaagttgaaaacagaaaagcaaaacataaaatcaatgaaacaaagaataggttctttgaaaggctcaatataattgacatatgtttgcaagattgacaaagataaaaagagaaacaaatcattaatcccaggaacaaaacagaggatatcactacagattctatggtcattaaagggataaaaagaaaatgctatgaataactttatactcataaattctataatttgtaagaaattgaccagcttttaaaaaccataagctaccaaatccaatcaagatgaaactaattaccatagtaacactataagatcctgaaaaagaatctccaggccaagatggtttcactggagaattttagctaacatttaaaaagaacattttataccaatgttacagtgtcttccagaaaatagaagagagaacacttcccagctcattttatgaggccaatactattttgatacccaatccagataaaaatagaaatagaaaactatataaaaagtaaaaaattgaaaactataaaaatagaaaactatagacaaatatctctcacaaacttagatataaaaatcttcaaatacattacaaaattgaattcaacaatgtatagaaaacactacatgacatgaccaaggaggattaatgccaagtatgcaaggctagtttaatattcaaaacatcaatcaatataatccaccgtatccacaggctgaagaagaaaaatctttttaattgatgcagaagaaacacttattcatgataaaaatgctcagcacactagaattggagggtaatgttctcaatctcgtaaaaatcatcaatgaaaacctaaacttaacatcatgcttcatggtgaaaaactgaatgttttgcctctaccaccaggaatgaggcatcaagatagataatatcctgcttggataaaaagaaaaatgtcccttttcaccccttttattcaacatagtactagaagttctagacaatacaataaggcaagaaaaagaaatagaaggtaaacagaagaaatgcagcagtctctatttgaagatgacatcattgcctacaaagaaaatcccaaagaatctaccaaaacaaggaaccctcctagaataatttagtgagttcagcaagattgtgtgatacaagatgaatatacaaaatcaattgcatttatatatcctaataataaacaaatagaacctgaaatttaaagtgcaataccacatacagttgctccaaagaaaacgaaatacttaggtgtaaaatcagcaaaacatggaaaagatttatatgctgaaaattataaaatcttgatgaaagaaattaaagaactaaacaactggaacaactttgtttatggactgggagacaacatagtgaaaatgccaattctctccctaattcattgatgtttaatgcaatttctgttaaaatcccaaatggctttttggagacataaacaagccaatgggcttctcactctatctctgctggtgccacaggggaaggaagctcctacctggccttcttttgctgctgggtagagaaacagatgttgagaggtcccagtaggtgactgccatgagttgagggtggagactcaaagcctggttcaccttcttctgctgggtggaagcctcagggacaccaggtctaagttaccctctgccattagatggaggggctggagactccaggttttctggtaccacaaagaagggatgcatgtgtccagtgagcatggggtgtgggacaggccaactaagccctggaagctttgctggagccactgctgctgctatgtgtgggctccatgacactgcccccttccagctgttgcatttggttttgagttcatgtatccctatttgtggttccgggttgccggcctctccagtgcctagtgtagggtgtatgggaagttacaacaacaacaacaacaagacaagtaactcaacttaggtgtcattatcaaagtcctaaggttcttagccagtgcatcttcttcattccgtctttcagagcgctttatgcttgtctgttaaattatttctagggcatttagttgtattatgaggggaagagtagggaaaagtgaacctgtactatcttgttccataactataggacggtttcttttaaagctaaaaatagacttaccatagatccagaaattgcacttataggcctttattccacagaaataaaacatatgttcatgtaaaagcttctacagaaaatttcacagcaactttattcataatggccccacactggaaactataccaatgtccttcaatgggtgaatgattaaacaaaccctggaacatccataatgtggaatatgtcagcaataaaaaggagaaattattgctgcacacagcaaccaaaatgaacatcaagggaatgatgcttactagaagaataagccaacaccaaaatgttacatgctgtatgattccctttatataacatttttgaaatttaaaaaattctagagatggagatcagttagaggttgcagggggttagggactggctagtgtggtcctagagggaggcagagggacccttgaagtgacgggacagttctgtagcttgactatggtggtggttactcaaaaccgcatatgtgataaaattgcataactggtgaaatctacataagctctgtggattgcacctatgtcaatttccagcttgtcatattgtactttagtgatgcaagatgtgatgattgggggaggctgggtgaagggtacataggacctccttaaacagttccttgccactctctgtggatctaagttatttcacagtaaaaaaaaaaatttaaaaagccaaaacaaaacaatattgctaatttccaaccacaaaatattccttttaaactacccctggccccatcttctctctctgtctctgtttctccatctctctcttttcaggccactgtgaagacctatttgcaccaacctggaactttcatttttacctttttttttgagacggagtcttgctttgtcacccaagctggagtgcagtggtgccatcttggctcactgcaacctctacctcccaggttcaagtgattctcctgcctcagcctcctgagtagctgggattacaggcacacaccgctaagcctggctaatttttgtattttagtagagatggggttttaccatgttggccagactggtctagaactcctgacctcaggtgatcggactcccaaattgctgggattacaagagtgagccactaagcctggcccaacctggatctttctatctgaggttctgggagggctggcagaaagtggaaaaggggataactttttagtgcctgatttggtggtatttcatgtgaactaccttaatcatggagccgattctctaatccttctgtttatcagtggcccctgccccatcctttgggaaacgttccaggatgtttggcacttaacactgggtacaaactccccacccaacagcagccgttcctggtgccttcaaacaaaaggacatggaatggggtaatattatttggataattttcaaaaatgccctacaaacgataagtggatcaacagatagattccaagcatcatgggtatccctttgggttggcaattgcagctgcgcattaaccaggtccttgggatgatggttgaatgtgagttgtatcctgggcagatagactcacagatgtgcacacaaatgcacacacacaggacacacatatggacgctttgtgctcctccaagctgggcattttacagtcaattcatggatcagtcaatacatttggaaacttagtaggttattagagtttcagaaaaagtctcaagttcaaataaaatgtgtgtatgtgtttgtgtgtgcatctactcacagtcttatccacccaaatctcaggtgcagcagtggtgccaacatcatgactttatgtacataaacttggccagggaaggaagggaccttaatgtgcaaatgtcccacgtgccatcggtcaagcccaccaccttcacctttcaagtttcttattagaactctagactacacgcctgacaggctgtcaggttgagtttcctcttctgtatgacatgggacaagcaaagtggggagaacatcttctacagggtgaaatgtcttcatcctgtcttcctcaccccctttgccacttaatgattagctttaatctaactagaaccttttggggtttctgtaatgggaggcagaggtgcagtaagaaatcccctttactacccagtgaaatacaggggcgtctccaagggaagcccgtctcacctgcttcctgtctcccgccgagaacctgctccagcacagcctcccagtctctgccccaaaggtgagggtgggccctgtgggaaagagacaggggacagatggaggggcaagagggcaggggtcccaacctgcacagaggagcaaacctgcaccagattgaaacgtaagctgaatgtaattacttggttaattaaatactgacttttaactcaaaaagtgattaaaacaagctgcagaaagactgtccagaagcggggcagggaatgaatcaaagctttcaagaagagggaggaggaagagagggttgtcacaggcaggtctggcttgctcttcctactgtgtactgggcctactgcatgcagggggtgtggtctttggtctctgagcaggtgaggaattttggactgaggccaacatgcaaagtaggatttcagacttcttatatctttccacttcagaccccatctcttttcccagttgtctgagagtaccaggagctgctggtgcctaggaaccgggtcctgttcatccacgtttccttggaacagaatgcagtacccggcacgaggaggtgctccagaaatgcttgcagaacaaatgaacaaatgactacacagtagtattatgcacatgtgtgttccgatgagcacgtgtgcgcgtgtgtgtgtgttcactgtaggcaggagctgtgggtcatgtgttgtaggctggtcttaactcaccagctcagacacccatgatgtcagaggatctgtaaaactccctgagccgtgtttcctccccataattcccagcaaactccctggtcctctgtattcaaggcctcagcctgttttccaggtccttctaggcagctggggatggctggccccattccagagctcggtgtctgcctgggagacttaggacctttagagcctcagatgtccccagcctgggaagtcactcagccatgactcagccgggcctggatggggctcagcagaatcctcaggacccccacggcctcccaatgctccagtccctgccacctccacccacagcctttctcctcccgtgtccttcgtcacccatgacatcatcttgtgcgatcatcctggctgcacaatcaagcctttcaagctcctcacgccaccccaactctctccttattgttgatttaacctcaaggggaccattctcttgatgcttccacacctcgcttcttcagcctgcaaattccttggcagcccttttgtgcagaacaccccctggttccatctaccttgcaaagctggagttgctgttttatttccttgacttataggcaacaacaaaaaaaaaaaaaaaggaaaaaaatcactcagtgtgtattttttaatctccatcaagagactataatacaacctgtaccatttttgtctgagcactttctggctgagtttgggttgtagcagatgggattttatgaaggttgtaaaagtcaagctctcagcatgtcaaacaaatcagtgtgtgaaggagaaacattaaaagtaggaaaaatggctgtggcctgggatgcattcggaggctttggaaaataagcccacagacctggagcacaggtggccccgaaatttggctgaaaattgcctttcaagagcaaaagttgctgcagtcaccctcaaaggatcatgatctaaattctctactcctgagtggggaccgtggtgctctgggtttaaaaatacaaattccagcatcaactataactatatagtcttatggttaattctgcttgagttttcacctaggcataagctgtcttgtatgtagaactgcaatcgcattaggagaaagggatctgtgtatgagtcttgagaaattatggtaataaaaaatggcagcataaccaccattaagtcagaagaaagataattacttctcatgctgcctccctgggtgaacacactgacacggagatgaattcgcttcagcaaaacaggactaatctctgcagcacggtatctattccattaccccctgcttaattacatgtgattgtagcgtctaatttatactgatacccaatgcccaatagagcaccttcatgaagagtgggttagttgggaggtgggaaatttataaactggtttaattgcagtcatctttgagctgttttatgtgtgacctcagggagtgatggtggttactctaaattctcactaatgaaagacaagagggttatggccagttaatatcacggttctgagaacacagataaaggtgacaatttgtctgtttgctctataattcactaatagttattttctggataagtgggcagggaagattgaacatggggatttcactgtgtgatgcaacagaagcatacaagcagcattagtatacacgtaagtgaatattaaaatgactaaggtgcctccaggaagcacagctatagatctctatggacaaggtaaagtacacggatttttggtggacgagagttttcttatttattattattatatgtatatattttgagacagagtcttgccctgtagcccaggctggcatgcagcagcgtgatcatggctcgctgcaggcttaacctcctgggctcaagtgatcctctcactttagcctcccgagtagctgggactacagacatgcaccaccacacccaactaattttgtatgttttgtagagacagggtcccactatgttgtccaggctgctctcaaactcctgggctcaagtgatctgcccacctcagtcccccaaagtgctaagattacaggtgtgagccaagcacctggccaagagtttcctaaaggggaaaggcaggatccatcctcccatatgtgcaattccatttagggctctttttgggacagcacacctggttttacaactcctttctagaaagttcacttatgagctgattaatggcagtaatgatttagtgtaagcagagcgcagtagccctagggctgaggttctaacctgggctctgttcccactggctggtaaatccttggctgacctccccaggcttccatttccgcatcttgagagtagtgatgatatcagcgacactgcagggacattgtgttggattgagtgagatgaaggagagtataaatgcacagcacagaccggttctgagcctcccatttcagagcaggaagccgggcctccccctcgaggatgcactgagagaggccactgtgagatctggcagagggtgtcttgatgtcaggtgatcagaacacatggcagccttggacatctctgatacgactcctgctcatggagtcattcatttgacagatgttattaagttaagtaccagatcatagcaaccacaggagttataaagaggacatgtcacctgcttcaggggaacttagagcctaggaggtgaaacagatgtaacaagtgaacatgacaaagtttgcagcaggagctgctggttgcttacctcttctttgctaataaaaatgggatctgtttgggcagcaacaggtccagttcaaggggagagaacaaccctgtcaatcatgacaatcccacaggtgggcacttgagcactgctggccaaggagctggaagggccagtcagctggaggcttctgggaatatttttgtccttgctaaaatgggagaaaagtattctgatttcttttcagagttattgaaagctggaaagagcatagctcccaaccctccaaaggaaaaaaccagacaagcaacaagtgcatgccttttccagagcccaacaaaatcctgaggttgcagagcaaacaacagtccccaaatttacagagagagagagaggcacttgtggggagagaagagcctggcttatgtgggcaagatgtagctagaaacagtaagaacagtccagcaaaggtgatggttcccaacaggggccaatttttttccctaaggggtagctgggagtatctgaagaaagttttgattgttacaactgggttaagagtgttactggcatccagtgggccagggacactgctaaacattctgcagtgcacaggatagcccctacgacaaagaattatctggcccaaaatgtccacgatgttaaggctgagaaaccttgagctaagtcaacattgtctctagcctggacaactacaatacactaacaggtcccccaggtctgcccttgctccctaccatccattccccacatggccgccagttggcttccatgtaaaagaaaccagatcgtgccactcgtctatataaaatcctccaatggctcacatcttgagacttcaccatggcttcacagcgtgcagcatctgttccctccatggccttctgatttgataacatgctacccccttctgtcacttcgatccagccatatagtctctctgcatccctggaagacaccaagaacactcccatctcagagcctttgtacttgctctccctgcccgggatgctctttgcccttccaatgctcatggccacatctcactcccatctctgctccaacatctcatttgcaaagagaaaagaaagagcccacccacagtcccacactaggatagtgcttggcacaaaataggtgctcaaataaatatttgttgaaggaatcaataaataaaatgaagacctgcccccttgaactttcggttaactcaccccagcctcaaattgaaatcaaagaagttattagaaacctggaagagagcagaaaagggaactgagggagtgagtctgggactgggtgttggagctctgggttcacatctggttgggtcagcagctttcagatgtgtccctggataggtattttcctactctaagtctcagattatttgtaaaatgggcaaagaagccattcattcagtcatgtcttcattcaataaaaatttattgagcaactgctgagccaagcactgatgcaggtgatggggatccactaggaaacaagacagttccttctggaatgaatgaccacacatttatcagctttaaacaacacacgtacatgtgacaaactccatagttctgtaggtcagaagttcaacacagcatggctagatacgcttctcagaatctcattggcccaaaatcaaggtgtcagctagagatacggttctcacctggagctcggagtcctcttccaagcttctggtattagtagaattcgtttccttctcactttccacatggcccaaacagaaggcacattgaatccttccagagcttcaaatctctctgactttttggccattcttttctgttattcaaggctaatgagattccattgtatcctccgaaataactcaggttaatcttattatattcccaggttccagaaattagagcatggacatcttttaggggccgttctcctaatttacatgtggatgcatgtggagccagcattccaggcagaggaaacagcagaggcaaaggccataaaatactaatgggcttgatttgttcaaggagcctcaagcaaccaacatggctgggcagcagagcatggaagagggaaacaggtgaggaggccagggaggtggtgacttctaggccatgtggtgcttggtagacagcaggaaccagaatgggttttgttctaagtacttacggaactcatgggagcattttaagccagattgtaaaaataccaaaccaatgttttttaagaagataactttgacttctgtatggcaaaaagtaaatgtggaagcaggaagaccagtttggaggacatggccatggggacaatggcttggactaggacgtgggggtggaagtcatgagaagtggttgggttctggatctctttaaatgatttttttaagctgaattttctgatggagtaaaagatttgtcaatttccttctagctgacagcagaaggggtggctttgatcggctttcatctccctctccaggcctccccatatcgctccacctggaataaaaataaaagctaagaaaaacccatctatcggcacaagcacagcatccagactagtcaccttggcttgtcacagccctcgccacactgagacatagacatagacattgatagataaaaacttgattttataaaaatcaaaagacagtaataatgaggacattcagaaaatggagaaccatttagctggaatctgaaatagtataatacagcagcagcagttaccatcctttgagtacaaagtgtgagaatgctgcttgaagttggagattggaggctttggggagcagtttctttacttcgctgacatcctggacatcacacatgggccttacaaagttcacacacaagcctctgcagcctccgtctgcttgttctgagatcaaactgggcggccttcggctctggctttgattagctatgcacagcctgactgcctgaaactcatgcaatagagatgaatggaaaatgaggcttgtaattattttcaaaagacgtgcagcctgacttcagcccatgaagacttccaggcccctggaaaagcctggctctgtggacatgcgagctgtgcagtctcatggtgcctccgtttagaagggccccatgttaggtttaatgcttggctctcttgaaattctcaataagttttgaatgaggggccccatgttttcattttgtgcttggttctgctttgaaactgcctagaaaccatctttcccattttcattccagttgctcaaacccctttctcaaacctttcagagaggaaggtagcacaggggatattcctgggactgtggtgtggaggggtgtaggttggttacagcagctcctggatggttgatgatgaggatgctgcagatatgagcagggcgttagctgagtgagacttcaggataaaccaacctggaggtccatcttccaaggatggaggtatcattttacccgagtatggataatctggggcaaagagcagaaatgtccctagccccaaacctatcaacagagtagcaagggcccagtgataacctcatcaaacccatcttgaagtgggatgggcagggccaagaaataaaagaggaagaaactaaccaggagcctcggccacactccaggcttgttctgtgtccagccgggctcactgcaacttggttttcagggtatgagctgagcggcagtacaacctgtgttgtttagcaacacagtaccttccccgtttactgctgtaaggtgttaacgaggaggcaaatgaattacaactgacagtttacaaagcaaaggggtccaggcatggtggctcacacttctaatcccagcactttgggaagccaaggtgggaggatcgcttgagtccaggcatttgagatcagcctgggcaacagagtgaggccccatctctacacaaaagaaaaacaacaacaacaacaacaacaacaattagccagatgtggtggtgcattactgtggtcccagctactcggaaggctgaggtgggaggattgcttgagccaaggagtttgaggttacagtgagccgtgattgcgccactgcactcccacctgggtgatagagagagagagagagagagaccctgtctctaaaataaaataaaacatacaaagcaaagagatgccattgctcttgctgcttcgtccccactcctctgagatggaggaagagtagccgctgttttaatagacggtcactaagagttagctgctcctgggtgtctatctttgtgcacacgtgatttctttaaggctctgaatttcctatagtgctctgcacagagcagtctttaggagaagagacatctggatatctatgaaatcagtattaaaaatatattctaggtcacccaattcccaaccgtagttcccaggtaaggtgtcaagggtggaaacatcctggttgatgtcatactgtctgcagtgaatggagctaggacttggacctggcctttgggcacaaaggccactgctctttctccatccctcttgactgctcaggtgagtggctgctcttactgaacaatatcagtgggcagaggatgggagaagtcatggttttccccaggacagaaactagggctggggcttctctgctcagaggccttgttgttactaggcaaaaggggttcactgactgatgcactggaaaccaatactataacaccagggttttgagaaaagaaaagcttttctattgcaatttaaccagcaaggacacaggagtccagctcaaattcgtctctctgtgctggctttgaggcagtcattttctatcaaaatagaattactgccttagaaaggacgccctcccaaggacccactttactgtgttttgcttttccttacaaccctgatcaccaccgatggagtgtgttcctcacctgtcttcttcaacacagcccactgaggcgggtttagggggtggattctgggattagaaggtgattggtggaaggaaaggagagggctggaagtctgtgggcatgcgcagttaccccttcatgccgcctcatgggttccatatacaaattcgaggagagttagcgtgaaacgtgcggtggaaattcatgctgtgacatcagcaagctcattctgtgcaaactccaggtggccatatcggttccaaccgatttcagccaatttaatctcgcaagcacggggagtttctgccatcctgtaaactcaagaatttgtgttagttattggtttctttaactctttggggcacggtttcattccgtgacttcaacacagaggagtggggaggcaatcccattgatgcactctggaaagcctgttgtgggtgagccatggcacagggctggacggtccaggaccttggtcccatgacacatgaggtctgttctgcggagccccagcgtgtggccctgtccaggccccgccactgtgtgtgtggcgttttattgtcaagctgtccttctctatcaaggtcttcatttgcatttggccaggcactggcagctcccagaagacactgggatttttccaatttgtttgtttatttcatcaacaaaagctggattccagactgagatgttaagtcctggggatgctgcaaggggtaggacaaacacaggctcagccctccagagttttctggtctaacgtgggcaatacattcccagggtccatggtgggtaggggccatccactctggtggggaggagtgttttaccactgaattgtagccagttttattatgggctttaaactttctatagataatgcacccccttactgcttgcacctgggaagactgctcgccccacccctttgctctcttactgtacccctgaatgaaggactccaggaagtacacacgtggtcacttgctatttcccccaacatgggagacatagtcctgcctcagggcctttgccctggctgtgccctaggcctggagctctttcctcatctcgatgctcagctcactccttgatttccttcaggtctatacttgagcatcacttcccagacaactttacaaaaaggatcctctcccaaagatccactttactgtgtttttcttttccttacagacctgatcaccactgatggagtgtgtattgttccttgccagtctttctcaacacagcctactttgcagttttgttcattactgtgtctccagtgtctgtcccttgaaagaagctcaagacattttgaatggataaatgaacagaagagaatacctgtgtgtgaatcttgttcctgccctgtgccagctgtgtgaccttaggtgaattattgccccctctgagcttcagtttctttatttcaaaaccaccaagtggctgagaaaataaacccaggcaagagaagaaaacacctgccctgccaggggagctgatgaatatctccttcttccttctttctttctcccattaaatttgacagcctctgctttactgcagggagagagccaggagcctgtttaggcggtagtaggactcctttccattcactgcactcccagcctgatctcagaggctcatgtagtcagcagagcaagagaaatgggctgggaaacaggctggatttatttccttcctttccagcaaagtactctaaggatgtgcccatccataacctcgttgctcacatgaagaccgagtgacgactcagatggatggagatgtatgaacctctctgcacatgtgaaaatccaaccctaagccatgcaggggaaatgggcaccaaactcaagggcaggcacattccagagcatggggtctgcgggggatggcctcgcccaacccaggcatggctcacacaccatttatttctttactgagctggaaactcaaatccaaagttttcccgatggccccggaggaataaaagaattggggagagggaaaaggtggagaagaaggtgaaagaaatgaaggaaaagaaggaagtgaagaagaaaaataagagggaagaaaaaaatgagaaagaaagacacattttaaactagaataaagtatataccctttcttaattgactgaccatgaaccaaatcagagctttcaaagagaatctgaccaaattgttatttcagtttactttagagtgtgatttgatgtaaagaagtcagtctgtcttgccccactaagccttgtttaaatgaactgcaatgttctgtaagtttcttctggaaccttagcccacccatatgctacaaatatgtgttactagggtgatcagccatcccagttttcctgacactgaaaggagtccgtggatgcaggactttggtgctaaaactgagaaagttctgggtacacgaggacaaacttgtcaccctaatgacaatgtcatggcttgaactatggcccctagaaagatgtatctcagtccacatccctggaaggtgtgaaggtcaccctatttgaaagaagatctttgcagatgtgtttaagttaaggattttgagatgagattatcctgggttactcaggtaggtcctaaattcaatggcaagtgactatataaggaagaagagaagacacacacagacagaagggaaggccacatgaagagggatgcagagattggaatgatttggccatagccaagagatgcctgaagccaccagaagctggaaaaaaatagagaaggattctcctctagagccttccgacagaccataacccggctaacatcttgatttgggacttatggcctccagaactgtgagcacataagtgtatgttgttttaagccaccaactttgtggtgatttgttggaacagccctaggaaagcgatacaggcagtaaagaaataaaaggcaaggtggacatatctggaactctcaggatgctttctgatttgctctatctctagcaaagtttctagaatacatttctggagaagtagaagtagcatgcataattttctaaaattctaaacaccactcccaaaactttcatatttacttaactcctgtaggcaacgtggcatgtggtcctagcatcccagttccctgggagatggccctcctggccagggtggtgcctttctttagctcccaggtcctgccccctggataaaggctgtctgcatgtcatggtcctagagctgggggcagggagggcatttgcaaggagggaggcctgttagaactgtgagcacatctcagcacacagatgggcatctctattagtccattcttgcactgctataaagaaataccagagcctgggtaatttataaggaaaagaggtttaattggctcatggttctgcagctgaacaggaagcatggctgggaggcctcaggaaacttacaatcatgggggaaggtgaaggggaagcagacacatattacttggctggaggagaaggaagagtgtgtgggaaggtgctacacacttttaaacaaccagatctcatgagaactctttcacgagaacagcactagggggttgatgtaaaccattagaatccacccctatgatccaatcacctcccactagatcccacctccagcactggggatttcatttcaacatgagatttgggtggggacacagatcagggtatatcagtatcacatctgatgttggatgagcatcgcatagtatatcagcgtcacatctctgcttgacacccagcgggcactgtgttttcttagattctgtgtttgtcttttggcatccattaatcacagggccaaactaatgcccaaagttgtttatgtctcccctgcaatcagctttggagggtgtttgaaaatcatattacaaactctccaaccaagccagagcacaaccccccaacttcttccttatctaactcccacacaccaagccagtatttcgcctgcctcacatcacccgggaccagggacaagacaactaagacctctcctgtagcccagagcctgcaacattattcacatcagccaatctcaagctgtttcccctgccctaccctgccctaccctgctttccccttgagaaacacaataaaggttcctgcccagacttttctgtggctccttccactgactcctaggtgggctggtgtgcccctttctcttgggaaacgcaagtaaaatattcttttgatggcacctgcttctccctgctgtcactcagtcacttccataaattgaaatccattggatacaactgggacagttggcatcacaggtgactcaacatttgatagagctgcatgcccctgggctgctcttggcttactaactggcttcgccaacaatgagcacccctggctgtggacatacctgcactttagcgcctccactctatgctatgtctaccatgtgctgccatgatgttccaccctaaattgtaagaggacctcaaaggcacatgcctccatggtacacctcactttgtatagtttagtttttaggaaggctaaaaccatcatcttggatatgcaacaagatccactgggtctgtttgatacccaggcacccaggaaggagggagtgcattgattgaccagcatacaaggctcctctcaagggaacagggagaggattcttccagaaggactgtattgaatctgatccacatgcccatcaatgccaaagtcagtgtaaggctcattcagcctgacttgagttcttttctctgggtaagtgaattattgcactaacctgccctttgagagagcattcctggcaaaattctaggtgcagtatcctctggtaaaccatagggatgcaacaccaagtactcctctcatggaagccattggcatccaaaaattttcaaggacaaatctctgttgttgcttgccttgctgctgttgcaattcgtctcctaacttagcaggatataaaagatcccatccatggagacaagtggctaaatatttaatggaaaaaggaaagaaggagcatgttgttccactccccttaagacatctgaggacgttcctcagctcatgcaagattgtaaatctcctgaccaatgtgtccgggcactcctgagtgctgctacctaatcaacatgcgaacagcctccttcttaagagtaaattgtcacaaaatcaggatgtgacatcattgttctcttgaatgtggaccccagaccttctgaggttgattgggacaccctagagagggaggctgctgctcacagcagaggtcactcaggactaccaggaacttatcaggtaaacacccaaaggaaaaaaaatgtctggggaaagacaggagacataaaaggggggaaaagtgggagagggaaggattttaaccacttagagatacaagccattctaaaaagatttaagagaaaaaaaaaaaagccaggggtagaaaagagactgattagggtgggtacataatcagttgcaggggagtggctgctgctagaggtcctgtgtcacttccctcacccccttttctcttatcagccagagacaaaaataaaaaataaaaaaaaattaaaaagcagtttcaggtggtcaaaagcctaaaacaaaacaaaaataacaaataaacaaggataacccttagatacagagggaggaaaaaatgtcagatttcttttttctttttttttttttttgagatggagccatactctgttgcccatgctggagtgcagtggcgcaatcttggctcactgcaatctccgcctcctagattcaagcaattctcctgcctcggcttcccaagtagctgggattacaggtgtgcatcaccacacctggttaatttttgtatttttcgtaagagatggggtttcaccatgttggccaggccggtgtcgagctcccaatctcaggtgatccacctgcctcagcctcccaaagtgctgggcttacaggcatgagccactgcatcccacaaaatgtcagatttctatccctgtctgatcctctcccacctctgcttgctgcttctctagtgtggataaataggagatgcagtgctgcatctacataccacagcttccagctctgcagggagatactgttcattcagggacagtgtattaactaccctaccaggacactgactgtgaagtcactgtaaatggttactgttgtgtaaatgtgagaagaagctgggcattaatgtgctgggtgactctgaaccaggcccccacctttctgaacctgtttcccagatctgagtcttggcttggcttggtctagatacaaattcacatgttgttgttgttatttctattttcctttattttatcatattcatttatttaacacagcactctctcttcaaataaaactttagcaagggcccaggtataaagcaactgaagcagaacctctctgagtgggccctcattcttctgtccccgttgctggacactgcttaggacccctgagacagagatttataacagaaaaccaccctcaagagggtgtgtctccttgctttgcagttcagaatcacagtcatattgggtcactatttctgagtgtatatttttaaagatcagatcacagctgagtgatctgaagggtaatcactccctggcttaaacctttcacctatgttcctttgcttattttgttaacttcagacccttcctcccatgaggccctgtacctctataggagcactcaggcacaccagaagacccctctcctcctcttctgtgtcctagcctggttgcctcctttctcttccttgactgaaccagatacttccctgcttcaaggtcttttccctgattatacccacttcctgaaacgctctcttggagcaaattctttggctgtctctttctacagtgtcagcttaaatgtcccctcctcagagaagccttccttgacccccagtttgaagtggccactcctattcccacttcagctcaccttttgtctcatttcaataacagcatatgttgaacctatgcatttgtttgtttatttatctatttactggtctgtttatggtctcctctaccaaaatggtcataccatgaaggcaggaaccatgaatggctgcctcattaaattccatatccccagcacctacaacaatgcctaacatctgagggctcaaaaactgtgttgaataactaagagaattaattaattaataaatgaatgaatgcactctgggtttgagaagaggatttttttttttaactactgcccttggtatctgtgaagcacaatttgaaagctcagtaatttgtcagttgtcacaaacccaactcagtggtagtaattcttacattcatgtatattaacaataagtacttattcctacattcaggtccataggtcaagcacgacttggcggatccaggctgggctctgctgggcatggctgcaggctgtgggttgggatcaggtctgctccatatgtgtttatcttgggcatagtctaaagggagagcagctcctctctggacacactcctcatggtggatccctggggacaagagcaagcaagcttcatgagcacatttaatgactttagtctcgtcacttcctctgacactctgaccatccttggtcaaagcaagtcacacagccaaacccacatcaatggaccaggaaggcccattatctgctgaacaataactcaaactatcactaaacttatgaccacgaacagtgattcaagaaaccaaagtttaatgcaggattgtttgtgatctaagaggctgtctgaacagggatggctgagattattagagagagaaagagagagagagagagaaattcttgtatctgaattactctgaaggaaaggctctgctgctggcagttaatgcaaacacacccacagccactgccagaagcctccagtctcaatgtgatgacatagtgagcaaaggagcctgggggtttctagcccaattcagtgctgggaagcaagagctcactcactctcccatccccctttcccactacccacccctcccctcctgccagcaaatggaggcagcacattttcactccaatttccacttaaagctgcagctgctgtcgccgcctgggaacccctatctttttacatgttattgtggatcagttgcccgctgctgcaataaagaactctcagtgggttgcctggaatttctaactcagtgccacagaaaacctggtggataaggaaacaagaggctgcgcttcagtggtggtaagtgctagacttaagcaggcaaccctgggtcctagcctcttctggtcagtcctctcccagacatcagctccaggagggaatctgcttcctcagccatgagggcaatgaggaccctcaccatagctatctatatgggatcctccagcatcctttagcctcgatggcaaaacactcactggctgttttcagtaagttttagattcccaatattgttcttgcaatcgtggggtggaggacagaagggtggatggtcaggtattagatcgatcaaatcaaattgcagtactcagaccctgggggtacacaatgactttctaagggttcacaggcaacaggccattttgagagaatcacttttcagattctcaactgacatgggtactctgtgggctcttcatttccacatcctcttttggtaacactcttctcccactttataaaacaaagattgatcagtcaatgttctggcaggagacagatagcgtacttacattggctaattggaggaaagtttcataaaggtattatttaaaacttgtgatccggatgaagggaaatagcaaacaatagtgccaggccctggctagtaacagtggggccctggggagggtgaggggaaagagccttctggaatctgcagacaaaaggagactctaggcgggggctgtcagacaggagctgtgaccttctgcagtggaggcaggcagcctgggctcccccacagtagggataaagaacccctacctcactcatctctcagtctaccatctctgcctgttctcgctatcccatggcaaaacccaactgttacaggaaaggggtcccggtccagaccccaagagagggttcttggatcttgcacaagaaagaattcagggtgagtccatacagtgaagtgaaagcaagtttattaggaaagtaaaggaataaaagaacggctacttcatagagcaaacctgagggtggctggctgcccatttttagggttatttcttggtgatatgctaaacaaggggtggattattcatgcctcccctttttagaccatacagggtaacctcctgacattgccatggcatttgtaaaccatccttgtgctgatgggagtgtagcagtgaggatgaccagaggtcactctcatggccatcttggttttggtgggttttggcagccttctttactgcaacctgttttatcagcaaggtctttatagacttgtagatacaggccaacttcctctctcatcttgtgacttagaatgcctaattgtctgggaatgcagcccagtaggtcttagccttattttacccagcccctactcaagatggagttgctctggttcacacgcctctgacacaaccacaagccagaaagcaagggagctcattttgatggaaggcattcaaacaattgcataacatgtaacagaagctctttaatctccatctgtttatttacgtgaacaagattcaccctgcttacagcaacaaaatcaaaattttttcaaaagggggataatgttgaggccgaaacctgtctccttatgatagtaagcaacagtcatccacgaatacatgaattaattgagaaaacagccccacggctgttatgtttctctgatcaatggtgcactactcactatcgttaatgataactaaattcagaatcacatgtttaacatttaaagctttacaggaacagaactctggatattatccgtttttaatttatacatgtttttgttgcagtatgatcaatacaagacttccaagcataaaagtaagatacactcccatcaaagttggctagaggagtagaagttctaggagaaaaaggcaaaatttccaacaattagagctgagttttcatgcatttttaaaatcaatcgtggtgggtatcaatcattatggtattgagtttccactagacacacgttaaaattgatgtaatagtcttcttttagaatataaatattcagtatttctgatacaatgatttaaacttatgattaaaaaataaggtgttaaaaatgtgagaaggtacatggatttttaaatggaggagaaaatggaagggatgagtgtggaaaacctagtaggggcagatatttacatgggcttcacttgctgttcatgtggctgggacgtcaagggatgaaataagataagattctagaaggtgtcctcgacagccctcatcgagtgcctgatgacaaggtagtaatgtgccgttcgaagagaaaattgctgggtggtcagaataggcctcctagagccaactggagatccagggctgggcaggcacagaggtggatttgaatatgtcgggaggaagctgcctggacctttagaaagaggaaattcacaaagccctaagaggctctcattttcaacaacaacaacaacaacaaaaacaataataacattgttgtgattcaatacttattgaatactattactttccagggactgggataagcagtatatattgatgtctacattggtatctcactcaacctaatccttaaagagagaatctctatcatgatggttatcatcaccaacttatagatgaggaaactggttgccttgcccagatcactcaccagctgctgaatggtagagctagaatttcaacagtaatcctcagtcctccaattccagcaccatcctttagtcaccgcaccgtattacttgcctctcttttgtttggttggttgatcacttatatagtcatccaatctttcttttgtggccacaggtgtgtgaaccagagcgactccatcttgaatagcaactccatcttgaataggggctgggtaaaatgaggctgagacctgctgggctgtattcccaggaggccaggcattcttagtcacaggatgtttactgttaagggaacagaaacagacccagaacttaacagatgcaggaaatgttttgacatcctgatatcttaagaacaaaagcagtcctactttaagaataagtcttgctttaaaaatagtaatatagactcttgggaaggacagtagttacacaacgattagcaatcctttatcacaaacccctgtagtggagcatatcttccccatgatgtttgttatcttatatctaatcaagccttgcacctaaggtgggggcattccacctctttcaggaatgtcctgctctgtctctggtacagccactctttcattcctttacttccttaataaacttgctttcactctactctgtggactcaccccaaattctttcttgtgcgagatccaagaaccctctcttggggtctggattggaacccctttctgataacaataaggcaaataatcgttgagcacagactgtgtgctgggcactttgcaagatagctttgtcgatacatcttaatgttggagagtcctcatccgtacttatttccttgtggaagcctgctttaatgctgttaaattctttccttctgtcttgggaaggaaggcaacacgcctttcagagccttggaagatgagcctttttctctttgcttttctttccctcattctccaacttcagggcccagctcccaagcccagtctaccccggccagtccctgagtgtctgcccccactcagaacccttttccacatcactcagtctccagcccatggagctctggccaatcagcacccacgtggagacgtctttctaatcagacttttcagtgcagctacacattaacctcaagtctctcttcctctgctcaaagattctagctcagtgctgagcaaaatggtctctgtgttcattgagattacattctgctgtgagtttccaaataggaaaaaatgacagtattatattaatatcttaaacaggataaaaatatatttctatgttctataaatgtggacagtccagggctggtacagtggctcctgtgatgtcgaggatcaggccccttctagcttgctctgcaatgccctgcaatgccctgcatgaggcttctcactcatagttcaaggtgtctgctccagatctgtcacccaagtccatgggccagccagcagatggagggaggggatgctctgtctctttaaaatacttagaatttgaacacagcacctaggtttatattccactaactagaagttggtaatctggtcacaaatacctacaaagtcagctaaaatgtgttctcagtggctagataaaggtctaggattctatgactatagacaaaagagatgaagagataatggatttttttttttttttttgagacagggtcttactctgtcacccaggctggagtgcagtggtatgaagatgactcactacagcctctaccttccaggctcaagcaatcctcctgcctcagcctcctgaatagctgggactgcaggtgtgcgctaccacgtctgcctaatttaatttttggagagacagcatctcaccatttgcccaggctggtctcgaactcctgggctcaagcaacctttccgccttggcctcccaaagggctgggattacaggtgtgagccacagtgaccagccaagagattttcagggacaatcagtagggtccaccagagcagccaatgcattctgttcactttaccctgacattgtcctctacccctagccctctggtctcacttcccatgggtttcagggaccagagcacagagtctctctgtgagcagccctcctccctatccctcaggaaaatcctatcttggtagttactaatatcaatatcaagtattatacagagacttgttctcttccaacttgtaacatttagaattggtgagaacatggtcacagatgggttcttcattgatttataatcaaattctcttattgtcaagcaaaaatgactgttttctgctcagtctgtcagttgctgcagggaagtgataaggaaaggctcttctgtgtcagtcacctaagtggtggctacgcagtgcccaccacctgtttagacgaggaagagatgagcacctgtctcagggtcctctgtcgagagggtccactctagctatttaagcagaaaaggaatttaggaaatggcactggggaggtcacagactctccagaagagacagcaaatcaggattcttgaagtctgtgcagctgggaataatgtcggaacgacaccatggaacccaccctagagaccacagatgtgtgctgccacactcaactaacttttaaattatttaaaattttttgtagagatgaggtcttgccatgttgcccaggctggtctcaaactcctgggatcaagagatcccgccttggcctccaaagtgccagaatctcagtctcttctaactctagaattctatgacctctaggaccagcatgtggagacctggaaaagatagatttagaagctggcaaaagagccaactctctgatttcctcttgcgttcagatttcatccaaccatccatcccccaggagacgctcatcagtccttgaagaatgcacctcctgattacaatcagatattttccaagtgccagctggagattaactgatgggaagtctcaggtcatagaggatattgggccacatctgtcactccatggggaattgtcatttctgctcagtactgaggagctacgacctggggacagaaaaaccggaggaattgcaaatttaaaacacacacagggagcctaactggtggtatctgaattagagcacattttgtccctatagtccaagttggaggcactgatgagcagcccaattttgtaagggtctcaaatatttacttaaagaatagtatagtataaatacctgcattaaatccaattgctgtcactattaaaaatgtcatacgattgtttatttctactgcttgctcagaaagcaacccatgcttgacaaaggcctgctatttataagaaggtgcacagaaatgaacagtattaaatttggtgcctgtttattcctccaagctacccatacaccctgctttacactgaaatgctttctccatgtttatccacattgtttctttccaagtaaaacttattacacagattcctcggggtattttttttcttttcttgattctggttaaataaactattgattttgttttcaaggtaacttaagggggagtaatacagttctaatttgataagtacaattgtaatgcattcaaagtaaacacactttaggggttcaactaggacttattttaaaaagaaagcaaatcaatcaatgattggctactatggcgattttagggtgggctggatggggatgaaactgcattggacattaatactgcagagacaaattatcaaaaggaaaattgacattagaggccatggaaagctcttccaaagacatgtacccttcaaggatgaattaacactgggtttcttcgggagcacggaagtaaactgcaatttttgagaagctaaaagaattttttctagatggaccaggaaagtctgcaagagtatttgcagggtggccagtctacttttccactctaagacaatgaacatcagtcttcaaagaggcacattctagctaccaggatacacttggttgtaggtggccagaaacccaagtccacctggcttcagataaggaaaagaatctatggcctcctgccaaggaaaagccagtgatagagctggccttgggcacatccaattccagagggtaaaaccttgttatcacatttctatctgtctcagagtgactttgctggattgaaattgcactgagacagatgccatcccctggtggctcagaagcctcagttttacacctcccaccctgtcccccagcagaggtccaggatgaggtctgattggctctgactcggtcacgtgccattcctgaaccaatcattgtgggcagagtcatgtgaaacctcattggccaagcctgagtcacatgatcaccctggcacagaccggagaccagcaaagctgtgttttctagagcaagctcaagagtgtggcttcagaagcatgggggtgaatgctgggtgtgttagtccgtttttgcattgctgtaaataaatacctgaggctgggtaatttttaaggaaaagaagcttaattcactcgtggcgctgcaggccgtacagaaagtgtgttgccagcatctgcctctcacgaggcctcaggaagcttccaatcataggggaaggtgaaagggagccggggcattacatggtgagagaaggagcaaggtgcgggggacgtgccatattcttgtaaacaatccattctcagagcaagaactcgctcattaccaaggggatggcgctcagcccttggcaagatatccacccccatgatccagtcacctcccacctggccccacctccaacattggaggtcacatttcaacatgagatttgaaggggacaaacatccaaaccatatcactccgcaggtacaaggcacctgtccactcacgcccatccgggcatgtcatcatccagagtcaacccgaagtccttgagccctttgactctactgacctttgggtgcctggatcgcagtagtcccgacctctgcccccaccaccacaaatgcaggctgctctcagagcctctgctaccagaacttggcttctgcccacatccctccctttctccacacttcagctccgacacctgtcccacgtgccctctactgacctcaactcattctgctttcctctctcatgtactaactggggttccagctgtgtcaccattcaagcatctgagctccctgacccatgtgttgtctctgacatcagccagccgagggccagctagcacgtgggcgagaactgcctgccaagaacagccctgctcccttgaccacatcaggaaataccgaacatgaacccattgtttgctctgtgaattgtgcctctggactcaggctaaatgcagtaaaactgtatgtcagtcaggtttcgtggaaacagaaggaaagaggtactttgcatgtatatttattgtattacgttatactacagatgctcttcaatttacaatgaggttacatcctgattaacccatcataaagttgaaaatatcattaaattaaaaatgtatttaatacacctaacctaccaaacatcgtagcttagcctagcctaccttacatgtgctgagaacacttacatttgcctatagttgggcaaaatcagcgaacacaaagcctattttgttaaaaagtgttgaatatttcatgtaatttattgaatttattgaagtgaaaaacggaatggttgtacggctactcaaaatgcagtttctgctcaatgcatatcactttcatactatcataaagttgaaaaattgtaagtcaaactatcataagttggagaccatctgtacattgaatatgtgcatatatatgaatatgtatgtgtgtatatatacacatatgccctaaaattatagaatacagcaaagagtattctttctactagtattgaagattcagccacgtatagattacaggacagaaccacagtatgagatcactcttaaacatacacaaagatttatttatggatttatttatggatcactcttaaacatacacaaagatttatttatcatcttcctccttctcatcatagctaatattattgagcacctttctaagccctttacatttttaatgtcatttacttcttttatcaatcctctgaaataagtgccacatttctcttcttgatttacacatgaggaaactgaggcacaaagaaattcagtgactttcccaaaatcatgtggctggtaagcgatggagtcaggtgcatggtaagattgacattttttcaccttgtgaagttgggggtggtcatgtgatctgttctagccaatggaatgtgatgggaagtgtgtatgttgcctggggaagatgccattaccatccagtactgtaaatgttttgcattcttaccttgctgacacatcctagatagcggaggagctgccatcacaggcatatgagtgaaagtgttgtggagtagacatccccactgtcctgagatggatatggatttgaacaataaataatccttgtttcttgaagctactgaaattacggcttttcccttttatgttactgcagaataacaccagatttcaaagaggacttgagcctcatgcaaatgttttcattatttttaataagggaaatgtattcatgtgtcatttgtgtcattaaagtggcacttcataaaaaggaacctaaggtgttataatggcagtagaattaatccttagcctctgtccctaatgtcttactccattttatgttgctgtaaaggaatacctaaggctgggcaatttattaacaacaacaacaacaaataaaacatttatgtggctcccaattctgctgtctggaaaagttcaagactgggtatctaatgagggcctcaggcagcttccactcacgggggcaagtgaaggagaactggcatgtgcagagatccacagtgggagaggaagcaaggcggaggggagtgtcagaccccttttagcaaccaactatatggggaactaatagagggagaacctactgtcctccccagggagggaattaatctattaatgagggacccacccccatgacctaagcacctcccattaggccccacgttcaacactgaggatcaaatttcaacataaggtttggaggggacaaatatctaaaccatagcaactaataaattaagacattccacatatctgtgtgttctcaatggttaatgattaatcattaaaacctcactctgtatttaaagaattgtggctgtaaaactttctaaaaggttacaccagtgttcattgctctattcttttaagccttctagtattttttaaggtaagatattcagctatgtcttcttaaagtgtaatttaacttctccactgttgatgttaaagaaaatgatcttttatgatcaaaagcttctatagcagctgctctgtgccaggcatgttgtgaatgctttacatatattaactcttttaaacctgacaatagccctttcagtcaggtattattattgcctatcccaaagttagtgagttaaagagcctgactttggtcctaggcagtctagttcagcgtcctcacctttaatgaccatgttactctgtctatctacaccccagggatcaagaacagtgtttgctccaaaatagttcactaatgattattatttgagttaatgagcaagtgaatgaatgaactgcacttcccaaagtcttttcatttacattatttcatttaaatgttgcagcaacccattgttcattgactgtgtggctagtatccccaggttaccaacgagaaaactgagtcctggcaaggtggaaggtcaagttaccccactgggaggtagcagagctgggcctcaaatacaaagcattttaactgctagttcattgctctttccacttctatataattaaggagactgactgagtgcagaccataagtcattgacattatttttaatcagttgggagattccagataaaccattcagatttctgatttgtctttaaagaagaaggaggagatttggctgcacggggcatcattcccacaggcagccatctgtcccctggagctgccacctcatggcctgcaagggttcatccacccccacagcagtcttcagagaggagaaattatcaggctctctttactaaagagaaaactgaggtctggtcctaatgctagaggcagtggggtcagctccagagccatcccttaaatgtcacctgtgctgaggctgagactggggcctgcagcatggacaggggaaggcacaaaacaggcctcagagtgaggagtgtttcctttcgactgaggttcctgagaatggagagaaatattttcccttttaaaggagatctgtgcccgccctaattctccagcttgccaggaaaaaaagtgcagctgctgttccaggcctcagaacaaatgaaagcaaagaaaagggtttctttcttcccttgcaggggacagatgaccttgctgcttcctctgagatgacacccacgtggaggtctgcattggttctgtatttccctgctctctcttgttgcttgaggaaagttctgagccgtctctgccataataaggcatagaggaggcctcaaatagcctgtcccgggcccctggctgcttcaggaaggacacattccttctagaagagcatcctcttggccagagttgctaagagccggcattcagaccttgacccttacgacacagagagtgcgcagagggcacagctttcctgcctgcttcctgaacaatttctatttgcctctgcacacagcattctgcagtggggtttagcaaggagagcagctgggagcttccttctttctttcattcttccctccctccctctttccttcctttatccacaatgtccaatacacatattcactaagtaattcctatgtactagacacaggggttaaagcagaacctaaatagagcctgccagccctcatgcctggtgccacactccatggggtagacaacataaacaagttaacaaatagcacactgccacctggggctaatggttttgaaagaaaaacagtaacagcgattgtggtagaattatggtgagttctttctgaaaggcattggagaaggtttctctgagctcccttccccctcaccccccgaatacacacacagatggtgagaaggagagagccaggtcaagacctaggggaagaacatttcaggcagaagaaactgcttgtgcaaaggccctggggtaggagtttgctttgcctgtgcaatgaatggcatgaggcccagtgcctagagggaggtgggaggggtggagaggtgccttgctgttgacaccgccaccctcggggcttaagctgcattggaggctccttctcctccgtcctccttcctttccctgtcctctcttttgggtcttctttgggcctcccggcctgtcttcatctctgtgattctctcccactctcactgtgtctgtgtgcatcaccctctctctctcagcagcacagagaaacatactcaagggtcaagggaacgcctaaggcactaataggaattactgaaggccgggcacggcggcccacaacactgtaatcccaacactttgggaggccgaggcgggcagatcacttgaggtcaggagttcgagaccagcctggctaacatggtgaaaccccctctctcctaaaaatacaaaaattagctggtgtggtggtgcacgcctgtaatcacaactactcgggaagctgaggcaggagaatcacttgaacccaggaggcggagattgcagtgagccgagatcaaaccactgcactccagcctgagtgacagagcaagattctgtctaaaacaaacaaacaaacaaagaacaaacaaggaattactgaagtcccacaatctatccattcaatcacctattcattcacaaacattgctgaagtccctaacctgtgccaatccctgggaatataaagctagtctgtcttctcaggaagctagcaggctacaggggagatacatgtgcagataaaactttaagcaccatttgaccagagccccgaagagcaaaatgaaagagcccaagggagtcctcggagggagtcctgaactctgccaggaaggtcaggggcgtctgcacagcggtggtgacatttgacctggggtggagtgcggtggtgacagcgtgggtgagaggtgaggtggcttccattcaaaggggacccaggtgagtaaccagtgagtgcatcactctgtgactcagtttccacatctgtaaaatgggagataccaagctcagagcacccatgccctggaattgctgtgaaagttatgagttaggtcacatggtgcccacatcagtacttggcacatagtaagtgctccacaaatatttgttgcatgaggaagcacacaaatggatgagttgaaagcacctttccatgtttgtactacgggtgagaccagaacagaacaaaattggtgttttccctccttaacaatctccaaatatggatcattcctctgatctgctccacttcctttgttttggacagtcagtggaattccagcagctggcatgatgggaggcaagtttgattttgttttagccaaaggcaacacagggcagaattgagcatgcagcttctggggcaggctctgccacctcccaactatgtgacttgggagaaaatactcacgtgcctgcctcatttgtcccaaatgggaatagtcacagggtgaagatttaagtaagtgtaaggaaggtgttgcagattcacagggtgagtgtgctatagtgtggctggtggaataatggccccccaaaggtgtcacgtcctaatttccagaacctatgactctgttaccttatgtgagaaggaggaattaaagttgctaatccactgaccttgggaatggggagatgtccctggattatccgggtgggtccaatgtcatcatggggtccttaaaggtgaatgagggaggcaggggactctgagtcagagatgtaaagatggaagcaaggtgacaatgtcacaacggcggagctcaaccttccactgctgtccttgaagacagaggaggggccgggagtcgggaaatgttggcatcctctagaagccagaagaggcaaagaaacgaattctcccctgcagcctctgcagaggaggacagtcctggaaacatcttgattttagcccttttgagcttctgacctgcagaactgcaagagacaaatgaaagttactctagctgctctttgagtaatttgttacaggggcaataggaaatgtacaaccaaccattgcatccacttcacgacccacagggatttctgtcttttccgccactgatttgccgtcgcctagaacaaacactgcctgcagcttggtacctgctgggtacacatttgttcaaatagtgcatagatgaagtctaggtcagtctatgcatttcatccccgggccatcttgtttggtttggagggtgcgtgtgatctattcctccctgtttaagaggatatttggggattattgctggaaaagttagggcaaaggagctctccctgtggatggggtgcctggtggctctgaggactgggacagtggcagtcactggtgccaccctgatggggaccagcagggagagaagcatgaatagtgggggtgagtgacttgtttggcagagcagagagaaaaaagggctgaaaatgcccaggatttgaaacccaggaaaatatcgaactgtctgctgatcgagtagcaaggaggaagagctgggtttagcgtaaatgaaagattgactctgaaagctgaagactttggaaaccctgtgtttcccaagcaagattctggaccatcagcataccagccgggaaaacacaggaggaaaccagcggggaaaacgcaggctggctttctggccacagtcattctgtctgcacaacccctcggtatggaatgagaggaacaccaactcaccccgtgcataggactttacattttgcaaagcatttaaagatatttttaaaatgtacttctcaagacaactcttattaacagcatctacctgggacagatgaggaaactggggctcagggagttcgtttatttagcagacatttattgagcccctactttgggcatgttcttggctccagggatacagcagagaacagagcaggtgaagagaaggcctgccttggtcaagtggttacactaataggggagacagataatctgtgtgaatgaaaggtgcggttgctcaagtcatttggctggaagagttaggaccgagattcccaggtcagctggttcagtggctttggtctcactccagatggtagcagagatgcttgggcgagggacagcctcctccaaggtaccccagacctgcctctgtggtcacagattggcccagagattcactcccatcctggcactgccctacttaggagaaaaaagaataaaccaaatactgttgatttcttttgataaaaagttttgatcctctattgatggctctggaattttcatacaagagatggtaatttggttggaagaggatttcaaagaagcttttattgtttataagtgttctctcccttccaggaagaaagggatatcacttcccctttgttttgtgaaactggggagggtggcgtgtggggctcgttctatacaattggatggaggaggcatcgtgtgttactccagacctacgtgtttcttggcaggtgtgcaaactccaggccgtctaccctgcactgtgatggtggagatcggtgcttcaaggttaacagagcaagatgaaaacctccaggatggctgagtccacgcgggtatgctgcctgcaagggtgagctggaaaaaacaacaaaacataaataagcacgtaagttaatacacaaacaaattcttggtgtgattgccactgagatttggagacgattgctgttagagcgtaagcccagctttctatgttcaataaggggccatgatgataggcataggacacttatctcaaagctgcctcagcggagcattcacagtttctacttggcatgtatatttcagataaataaaaatggaacagtttcataatgcttattttttactttatgtatgtgttttcttagtgggacactaatggagattcagagaggggtggatgaacttccctttctaagccgtttcttggcactaacactagtgaagaatattaaaccaagaactcaggtgttcggggatttcttaaggggcaactcttattgcgacttaattaagaagctcagctgagaagcatgaggctattaaacagaggttgacggagccctagttgattcagggctgcatagagacacagcctttattagtcttctttgcttctatgaaagcaaagtaggtttgtgttccacttgggggctaatccattagtcgctgcaaaatctcagaggacaggcaggtccatttcaaacctcatttgcagtgagcttttcattttagtggttttggaaaggaattcatatgcctaaaccctagagtgtttggttacctcatgcaaatatttaatacccacagcaaaatttcagtataacaccaacaatttgttttccttgatatcagcctcatttgtcaaagctattgacccaggcccgtaaagaaatgccactcttggcccctttgtaatggttttatgcaaattgctttcaagatttaattctgtggaaatgtttaggaagaaaaaagataggaagagaagctagaccaaaactgaatatgaatagaaggatggaggggaaggaaggggcagaggagcagaggtggggtcctggagagaagggagacagaagaggagggacaggtaagagtgtcctgacatgttaaactggactttctctgcaacatggagagggttgggagcttagggaagaagatcaactcctatcccgtacacttgataaataagacactgactttgaaagtaccaaatgcaactcacattattttggctctgtctgtatctttgctctattcctatttgagcaaagacagagagaagccagaacaataatttcatgagtggggcaaagatggcccaacagaggaaggtcacctgaggacccacaacactttccaaggggcagaggggcaaggatggctcatacacttccaactactctcatcccctaaactgatctgcagagagcatgcttgctgggtggtcaacacgcctattgtcttctcccgtcacctttttccgattctcctcctcccattttgccaaagagagcgtagtttcccacccatccctcgaggtgctccgcctcgagggtatcaaacaaagggatgactcagaaccttgggatctggggccagggctcctttaagcaaaattccacgatgctcaccattcagctgttggagagatgcattttcaatatcaaattcttttcattttgaaagatcatcacgcgtcactttttatttatattgttttcatcaagtgggtactgttgataattccaataacttaattcaaaataaatttttaaacccttaaagatttatattcacagtactctttaaaattacatgtgtgtgtgtatgtgtgtgtgtgtgtgtgtgtgtgtgtgtgtgtgtgtatgtagtcatctctctgtatctgcagattcaaccgaggatcaaaaatattcaaaaatgaattgtgtctgtattgaacatgcacagacatttttattgacattattccttaaacagcattgcataacaactatttacatagcatttacattgtattaggtattataagtcatctagagatgatttaaaatatacaggaggatgtgtgtaggttatatgcaaaatctacaccattttgtatcagagatttgagcactcatggattttggtatccaagcgaggtcctggaaccaatcccccatggatactgagggacaactgcatatacacacacacacacacacacacacacacactctctctctctctctctctctctgtctctctctccctgtctcatatatattcagagaccacaggagcagaagagcattcaccagctatgtttgactttagcatccaggccttccaaccgtgcagacactctttccatgtgcggttggactccagctccagggaccactgggaactctctgtgaacagttctgtggtctacattacatctcacataaaatgcagcgatttcacaggctgcagccccaccaaaacagtctcataaatggttttttaagcttccattcagcatataatgcggtctcatccatttcattaatcttggttacattcacattttacagttttgtttttctggctaagaccattgaattttttttttttttttttttttttttttttttttttttttttagatttctccatttctaatacggaaatttggatttctgctcagagatcatcgttcaccaagaatctgaatttttaatcaatttcttatctatttgaacacaacatggatgagagacatgtccaaacctttctgggttgcaaatactgagtgggaggccagccttcatcaccaggcgagaggtcttgttccacccccgagcttgaccgcatgggaatcaaattcatgactcagccaagcttggcatggctgcatgtgatggggtatggtggccatcagtgctatttgctaaatatgtaagggcttccttcctgccttttggtagaattgcacttccctgccaccttgccgtttggtgcagtcatgtgactggtgttgtctaagacatgtgagtggaagcagcgtgtatcatttttgagccaatgttcattaaaccactttagcttccacctgtcatggtgattttctagaaatgtgtcaagatgaaggctggggccctgagcaaatacaatgtgcagacaccactgtattcacagaagggaaacatagcatttgagagaattagctgtttcttattttaagctgctgagatttggggatcttttaactgcccataagccatcccaattaacacacagagtcatttacaaatcattaaagcctctgatgttaaatctgtgaattgaaatgttctacaatgtgcaaatcactttggtaacttttttttttttcatctagaaaaactcagtccttcgtcagctctgaattgtggtggtaaactcctgggttctatctgaagtcaaataccaaggagaaggtgcaagcttcgccttctggaataaattcagtgaactgccaagcttccattctctctccttggtacttgacttcagacaggacccgggagtttaccaccacgatgtttcctgctgcctgctgtagccctctgagccctgggtctgtgctcactatgctgatcctggcgaccatgacctcagtgacatttctcaaaaatcccattttctgctttgacctagggtcagagacacactcaataagcaagcctggtgtccatcaaacgttgctttaaataagaacataaacttaaaggtctttacaagagaaatggcatgtgcagctaatggagaccagagaaagagttattagtccaggaaatcaggaaaactgattagcaagacgaaaggacatggcctgaaatccaactaagcagtgacagatgcagatattattctgcaggtgttagttcatcctgcttaaatagcaaggcctgaaggctggtgggatccttcactcctttacgttgacaacaacaacaaaaaaacaccaaaactcaaatttagataatcatcaattgcagaacaattaaaaattatctttgtaaccagaaaactatttttctctccctgcatgtaattgtctgccctttgtctgaggccttaacagatcagaggtcaagcattcttaagctttgagtggaaccagagcactcaatccagcatcaaagtcctgaatgaggtcggctcctcctggaaaatttttgaaagtacacgtcatcgcattccgatgattctggccttaaattttccttccatttcttagctgaaggcctaattgaaaacagccaaagctagttgggtgctctgtcttaaaggtaaagaaggacaccttcaggagaaaggagggaagagagctgatagcttgatgactcttcttgctgaaccagctgaatctaaggactgagtagtaaccggccacacagtataattttagggaccctctaagtaccactggactgctgtgtgccttcaatactaccattattgctcctttcaggtgaaggcactgaatactccttttaaagtaaaaacatcatataattggaagatttaatcagtcagcactcttggttgcatgcaacagaaaacgagttaaatagctttaaatgaaagaattttattacatcaggtgactaaaatgtgccaggaatgccttgttcgttgcaggcacagctggatctagaggctgcaatgatgtcatcaggtccggacgagtgtctcctggcctcttggctcttctttttccctctcaggaccattcttagagagtatctcctgtcatggctgaggacagattcagcccggcagaaaagagcctctgctgctctcagaagccacaataaaaggcctgttgcatctcattggccccaagtgtgtcacatgcacccaggcactggaacattcatggcagctttgtttgtctgtgatcatgaaaaacacagagccagcccggatgtccaccagctggagctcatggcgtggagtactctacagaggttaaaataaactggaaaagtggtcatacatgaaaatgcagtgaaagtgaaatacacgagcatagtaaacctaaagttcaggtgtgattctcagagggagggaggcaaacatgatggtggagagttacactagaagcttccactgtgcttgtaaagtttgatatcctttgtgaaatggtttgttgcagaatagttttctatgcacctaaaatgcttttgaaaattcaagccacaaatacccaacccacactcagcgtatcatctttgccctgaaatgatgtctgtcccacgtgagtctgtgcatcttgttagataacctcagaaacatgagaacactcgactcgttctccttagcagcaggctcctgctagctccgttctcctggatccctttggatttgtcttgctgggttgttggggagtggagacgccctcctccctgaagcgtttcctcacatggtgatttgtctattgtgcatcagtcaggatcccgggaggacctgcaggtgcagccacctccccacagggacagaaccagatccagctgccgagaaccaggagacccaatgtcaggtgcaattctgtgctgggatctgagtggaaccacaggtctgtgcagcaggaggtgagaagctcatgactacagagagaggcatggctggggacccagtgcctctgccccatctccatctctgcacctcggggcagcagaacactccaggcctctctcacagtgaccagcatggagcaaggctgcccatctccccaccagcctgccctgagtatgaaactccagcattggagattccttcctttttggttttccttctttcccttttataactgagcaacttctaggcaggatggctgaatgagccataccagtccaccttcagcaggggcttctggctggctgatggaggcatgtctctggggaacagcagagctcagggtagggacagaacagggagagctgggaggaaggagaaaggccctgcagcagacgctgcagaagctttccatcctccttgccttaacctggggctcacccaagtctatactcgtggtgagggcagggggaaaattgctttttcttaaagtcagtcattgatgacacctcctatcactgagtattcttggggcaggcctgccccaaccagctagaccaatggttcctacggaatttttaaggtggacagaaggttcctctggggacgttagtcagagctgggtgtctaatggagccctcaccgccagttcagccagagcagcttgtttttgatctgtttgacaaatagaacttttccataaggttccatttgaatgaagtcttcacacctaaacatttgagaatggctgcttcagtctaagctgggatcatctggtttcaaaaccgtcaaagaaatttcagcaggaaaatttggtcaaatagtattgccctgggcaggcttgtatgcccacccactttagccatgggcattagttatctattgctagatagcaagcaaccccacattttagtggctcaaagaaacatgtatttgtcatctagcagtttcgtggttcaggaaactggatgtggcttggctgagttctctagctctcaaggctgcaaacagtatcagctggggctgtggtttcatcctaagactcacctggggctggaggacctgcttttgaacttattcaagtggtctttggcaggatttagttcctcaagacagcggacctgaggcctttggttctttgtggctgttggctggaggcctcccttgattctcaccccatggggagctcagcacttggcatctggctcccccagagcaagccggtgatggggagaataagacattacatcagtcttttttctaccctaatttcgaaagtagcaccccatcatttttcccatattctatttgtttgaagcaagtccctaggtctagcccacattcaacgagaagggatcacacaagggcacagataccaggaagtggggaccattgggagccctttttaaaatctgctccccacactgtctctggctacattttagatagttgttagactaaactgtgaataattgacagactgcaatttcttctatttccctattttagaggtatctctctcctggaaacagcccttgttcacaccagaggtgtgaacagaaattcttttgctttgctggcctcaaactgatagaaaaatgtatcagttcaggcaaagtgttcctcactggtttgctgaattatgtctcttctttttatcccttaacttataattttatggactgtggaggaggatgggagaattggggttgggttttctattttctttttttccccttcttcagggagaaaaaaacttggctagagttgagtgcctcctaatccccagtaggaatctgacattttaattttgctttctcgccctctccagtctggcctgaggtgcaggtggggacctcccagcactgttatcataatcccaaacagccatgacagaagcctgcctgagggcttcaggggagactgaagagtcccaaatgcatctcttgtctaggatgatgaaaagttgattcgggcttgctaccaaatgttacttatcagatgccaagtggcattgtctatgcatggcgcctggtcctgccggggagctgattgagggtgagctccatccagagagcaggaggggtatctgggcactaagctaggtggatttaggacccccagcacagtttttggctgggaccattgtttggttctgacaaacagcagggcaccatggagacaggaaaataggcaaagaaaatgactcatctggctggaagcccagaaaatgtatgctaataccttcacgcagacaaaaataagattataaagagactggtggcaaaaaaaaaaaaaaaaagccagcctcaaatgatgcttctctttaatccatccacttagaagcccaacaagttgccgagatccaccgtgccaaagagagaaccatcatattagtgaagttgcttttcatgtcaattctttcctttctgtaactaaaactcaactatgggagacatactcagcagtcaccaacattctagattcccctcctcttcccatcccacaaaaggtttacaattccccatccttgaagttatgtatggacataagatcttgcttggccaaggaaatctgaggaagtgacatgtgttgtttcagtataattatttaaaagctggtatatgattctctatggtctcttgccatgccatggtgatcatgggagcatgtattgagatgcagatactgaaagatggtggagcttctgttcctttagatctctgagaagttaaaataaactgggcctccctaacaactcatgtgagatatatagagtgtgttttgttgttttaagccaaggggatttgggtactgttgtttgttgcaacattgccttgcttatcctcattagtaagtccaccatcctgcatcccaatatactttctgtagacacattaaaagcttaccacttcccggaaaggcacagtggctcgcgcctgtaatcccagcactttgggaggtcgaggcgggcagatcacctgaggccaggcgttctagactagcctggccaacatggtgaaacctgtctctactaaaaatacaaaaattagccaggcgtgttggtgcccgcctgtaatcccagctactcgggaggctgaggcaggagaattgcttgaacccggaaggcggaggttgcagtgagccgagatcacgccacggcactccagcctgggtgacagagtaagactccatctaaaaaaaaaaaaaaagcttaccacttcccttaaacttaccctcaattaaagacttattctctggccctcctaacaaaaatacaaacttattactgacaaggcagcacctgggtccagcaaacagggattccggcgcccaaacttgcatatcatgaaagggaaaggagcatttaaaagctctgacattggggacagacactttaatggttctgtcaatggagattaaaacttgaaaatagccaagggtacacttttcgaggtctatattttaaatgaaatgacaagaggaatgaacctgcgggactaaagtgcttggcaccatttgggaattatttgagccaaataattgctgtcatgcctggtgtgatgtatattttatttcaatcttttaagaaataggaaggagaaggtgagagaaaatatgttctacacaagagactggacaattgatcattaaccacagactcagaaatcaaaggagctcagattgcttttgctcccataataagggagttgtaaaaagataggagatggttacaggttatatttataaagcattaaaactgtccttctactagaaaatacaagcttaagctcagcattataggcaaatgttgcttttgtgttccagcatcccttcacatgacttttaataaggttatatccccctttttattttcctggatcaaaccccagttcacaccagagaacattgattctaccctcagttccagcatgagtcttatgggcttaggtcagaaacctactttatcctgtccattctcagtgattggtttagtgagggatgtgtagttcaacaaagctttgtaacaaacagccccaaaatcttggtggcgtatttaaaaaaaaaacaaaaaacttctttttctcactcacgagtctgcaagtcaactggtgcatctctgcttcagagttcagaccagatccacctccacatatctccatcctgggttcataggatgcttggagcctgcccttcttgtgcctataccataagggcaagatcctaagcatcccacacaagcatatctaaagccttctcccatgtcacgtccactaataccccactggccaaagaaagtcacatggccaagaccaaagtccttggaatgaggatgtcagggaagagaggaaagggattgggtacaatagtccaatctactgcatccacgtggctcagaaatggtcagttacatgagtcaacatcttccttttaatattgagttgagtttttatgatatttgcaataaagcgggtgctaactgagactcttagtgggccttgtagtgcctggacacagttgcatatttgtcaatttctccttgagaagaacctcagaaactctctaagtgaagcagaaagttggtgaaagatctatgacagatgacaacagaggtgaggacaaatttctaggattcagccccttctgatttctgaagtagatttgggcaccggcttccagctatgagcaataacatcagaaaaattcagtctggggtaaaggtcaccctgaattaagggagtgaccgaaccaaacatttacaaaatgagatgagctgccattcctttcagacatccatggtcactaaaatacacagtcctcttgtccccttgctgacactattagttaatgtatgggcttaaattagacagttgagccatgcctccagatgggaaggacttggtaactgttactcatcttctcttctcatcctcaacacaccttcaatttaaatggagttgatcccattaacaactgttagccaagatctttcagggctgggccctgtgcaattagggaagcacctggtagagctatccaaccagagtctgatcccagatccttcccttccaggctgtgagatcctggccaagtggcttcacctctctgagcctcagcctcctcatctttaagatggactatcacccccatatcatgaaatgtggctaagaagataaactctgggaccaaagcaccagggtttaaatcctggcttctccacttcccagccatgtgacttgaacaagtgatttcacctcttcactcctcagttttctcttctgtaaaatgggaataatgacagtccctacctcatgaggtgagtgtgagaattaaatagctaacaagtagaagtgcttagaagagttcctgacacattgatcactcagtgtgtgttactattattaaaactggtagtagtagcattttccttcctcttaaggaacttagaaataatcttattgtcataagtgtatagacaattacatatggttcagactccaacctttataaagtgaatgtgttctatgtgcctggcaccctgctaagcagcttatatacattaccacattatcatatttattctcacatgatggtgatgacaatgacgatgatgcatcctccatcacaacaatgaaaactgtgaggctcagagatacccagtgacttcagtgattaaggtcacacagtaaattatgcttaaatccaggatttaaatgcaggccatttgactccagaacctgagtctccccatctgactatccggctttcacaggaaaagaaacgtaaaacacaatctcattcatctgattgttcattcattcaatagtatttattgagtccttcccatgtgccaggcatagaagaaggcagagaaggtgcattcacctattcatccatccatctatccatccattcttcatccatccatccatccatccatccatccattcttcatccatccattcatccatccattaatctatccatccatcctttcttcatccatccatcattccatcatccttccatatgcacataacacctaatagttctaggatgtaatgtctccatcaccagcagagtttctatcattcatgggatgaattctgggttttcactagaggcttccccatattcactgtaaatttctatgcccagaatctattcttaggaaattaggccagtctctgcttccccagatgctaagattcacatcctactctccaaaacacaagcatccgttggatgcccagctggtccattatcagattcatctggctcagtctccagactgggtgagttgtctgtacaccccaggatgtggatggatgcaggctggatagcgggggtgttcacatcttggtatttacaagatgatatttacatcttggcttcaggcatgttagcatgtgagtcttcatttgaaataccataaattaatagcgactaaaattttaacatttatttggtttaaattgcgctctggattcagaaatatatttggactaggagctcttccaggaatatttaaatgatcatattttgctaaagttgaatctttaaagaaaatatacatattcaactctttagtgagctggattctgagctgtttttatttcctttcttaaggaaataatgtgtaacatttagttttgattctgtgattggcattccagtcgattagcgtagctcatttgggtgtttggtttaattcagatgactaaaaatgcttatttatataagtaaacatatctgtaaagtagtcacatttcaaaaattttggaaaataaaattttgaaaaaaatggacatgtttgatgtacgatgcagcgttttccattgcaaagttctgaatcttcaagttctgcaatctttatgactagtctgttgtgtttattggggataagaccacaggtctctataacccagaacccatttgatacatatgggggacaaagaaaggaagagaagtatgacatggatatattctatctcttgttttcttctaatggaagataggagattaaaaagaataaaaaagaagagagaaggagcatcaatgatgaagaaagaaagaagtcaaaagcactacccaattttagagaaaactctgtgtacagagacacaattaggttgtgtcagagaagcctagttgcctactgctgtgtgggagctcctagaaaacaagccctctcctgctttgggaatctcagtagatgtgaggatgtgggcattgtggccactttcccccagtaggtctctgagtgtaaaaccaatacaacgatatcccttctttccttctttatttgtaactgaacccttattttgtatttcaagaacctaaataaccagctaaaaacatttccaaggctctcttttatcctggagtggtacacagatctaaccaatggttattaaacataagctactaaataggacttccaagaaaactctttaaaaggagttgacgaagtgctctttgtcactgtctgtcttctgaaacttggtcatgttgactggagcagtggcagctatattaagatcatgaggatggagctcacaataaagataggggagtaaaaagccagaagagactgcctctagacttgtttaatgtgagaaaaaaataaacctccaaggtttttttaggggggagggagaagggaagggtctctgtaatttttagccaaagcaagcctcagaaaccttgacccttattttaaactacacataacataccacctcctgatgtggcagtgtgccaatttcttctttctaggtgggttcttttttgaactgagatgacagatatttctgcgacttttccatttgcatggaaaatgtcaaattataatgtatcattttcatttcaccatactaacaaatactcccttgaagtcaataactagagagctcatcccagaagtaatttcctgttcatcaaatttttgaatatatataatttttatttgctactcctgctgggaaacctgttggcatctatgctaagccctgaagattttattgctatttttctaaaattgatacaagtcagccctcagataacctttgcacgtatgtgtcaagaggcatcacagaatcatgaaatcaagagttggaaggaacgtgaagaatcattagagttgagatttgcttacgcagtagggtgaaaatttatagacgttgttaggtgtcaagacacatcagagtcttgttcactcctagaaaaaactgctcctccacccaaatctttctgatctaagcagatcagaacgttccattcttcccaattattcagtttgggtcagccatgggtctcactgaaggtgatccaatcagaatcaatcccagatcttttgtgggagccagcccctttcccctttgaggctctcagtggattcgaggacatggacactggagccactttaatctgataggtctttgagagtgacagccagtcgggtgcagtggctcacgcctgtaatcccagcactctgagaggccaaggtgggtggatcacaaggtcaggagattgagaccatcctggctaacagggagaatccccgtctctactaaaaaaatacaaaaaaattagccaggtgtggtggcaggcgcctgtcgtcccagctactcgggaggttgaggcaggagaatggcgtgaacccgggaggtggagcttgcagtgagccgagattgcgccactgcactccagcctgggcgacagagcgagactccttctcaaaaaaaaaaaaaagagtgatagccataccaagatgtcccagtgacctcacgtgagcactgaatctatctggacttgatgtctgactgcaataaccatacaacttactgtccaacccaaggcacttgtcaaagtgagttggagtgctattaataattattacagttattagttaacaagcataaatcagaattgctgtaggcaaattcttgagacaagaaatctcatgagacaaaaaatctccgtcttgataaagccattcagattcttggagtacatttcatctccttacattagctagagagcagttctgtgacttattgataaggcgacaaaataatttgttattcaaacagggtcactttggagagtgaaagagactgctattaagtaaagaagcaaacaggcacacactgggactcccctattcagaaaagggctcatcctacacattgagtgactgccaggtagaaagcactgctcttatcaagaagtgagcaatgaacattgtggggtggggataggatgggatgatgtcttgtcttttgcatcttgatttacaaaagcacaaggactccctggttctgtcctctactgattcctgatacatttgtgttcctaccactattcttgcttacaaaatagggcctgtttataaaccattgcttaagtttttgccaggtaatacattcagatggcttaacaatcaaagtaatagaagaggattcatttaatgggctcactcccactctgagcactccactccctcgcaggtaaccactttaatagtttctaatgtgtccttcattgctttttcatgcaaatataagcaatataaacacatagaaccttacatttctcctttcgtacatgaaagcaatatcctatgaatactgccatgccccttgctttttctcatatgctagatcttgcatatattcaagaataactaccccatgggccaggcatggtggcttacacctagaatcccactgctctacaggctgaaggcaggaggattgtttgagcccagaagtttgaggctgcaatgggctatgaccatgccactttgccccagtctgagagacagagcaagtctctgtctctaaaaaataatagtgataataataatggatctcatttctattttatccatttcagtatatagacattcaatagtttttactagattgcctttgtttttgtttttaactagtgtcctacagaggaatgctgaattgttttctctctttggttctcaccaacaatgttgtgatacacacccttgatcataagtatttgtagacaaatgcctgcagcataaattcctgggagtgggattgctggctcaaacactaaatgcacttgtcatttttaaagatttctccaaaatgacctccacagaaccagtgctgcatcaccccccaccagcagtgttagagaatgtctgcttctccacagccttattgactagggtatcatcacactttggaaattttgctgataaggtaagcaagaaaaggtttatcagtctaatttgttacaatcaaaaccatctatgttaaaaagacgcccaggaatctataaagcaagtagccccacctgacatcactgatcacgcttgcggagcagaagagaatggtgccgactccgcctgggctccgccccgccccgcccagctacctaaggcagcgggaacaaaatgttcaacatttgacctagtcctctgccaggactgcctcctggagcgggaggggggaccccaattcatgtttttatttgttttatcaactgttgtgtggaaggtttttggggtttttttgagacagggtcttgctctgtcacccagactggagtgcagtggtgtgatctcggcttactgcagcctccacctcccaggctcaagtgatcctcccacctcagcctccctagtagctgggactacaggcgtgtgccaccatgccaagctaagttttgtattttttttttttttttgtagagacagagtttcatcatgtctcgaactcctgagctcacgcgatctgcccacctcggcctcccaaagttctgggattacaggcttgaaccaccatgcccagctgttttttttttttttttttttttttgagacagcctcgctctgtcacccaggctggagtacagtggcaaaatctcggctcactgcaacctccgcctcctgggtttaagcaactatcctgcctcagcctcccaagtagcttggattataggtgcgtgccaccacaccaggctaattttttgtgttttagtaaagacagggtttcaccatgttggccaggctggtcttgaacttctgacctcaggtgatccacctgcctcagcctcccaaagtgctgggattacaggcgtgagccactgcgcccagcctgtggagtttgttttttgttctttttttttaacattacagaacactgtgccaatgacctgcccccatcaaatggtcacacatgctgttgccagcacggcaatgctggcatctctttttaaactcgccacatgaggaaaagtggagatataatttctcttggcttcctgagtggtacaagcatgtgtcaagttaccagggagatttgatgaagtgtaatatacctggccatctgacagttagtggccttgtttcctttccctgcgataatattggatttcatactgagagcatcaacaagagaaaggctcatacctaacagctaatatctgcagaacatgtgtttctgctcaatttctgcacctttatggctccatctgacactgcaattctttctgctgcaaaacagcctgattcgaatcatctgtcttacatctaattcaagttgaagtctattaggcaaaccaattcctggcctatttgtgtcccttctcacaaattattctagctgattctctggcactagttttgtttttgttttgttttttgttttttttttttttccaggaaccaatagctgaaaaacttctgatgatgttaaaggagatctcatattctttttcatgttgttttaaatgacagatgacaatttggcatcctcacaggacaacgtgtccatctgacataaataatgtgctctgatttttttttaaagaaacacaaagcaggagaagatgtccacctttacattttccagcacaaaaccaattctttggaaacctgtatgtttcttgatcatctcttgccaggttctgacagctcagtattcaagttgctcacggcaacagccttgacaccatgctgagacacgtgttgtcttgttcttcacacataccatgcccaatacacatgacaaagactgttggctcgaccttaaaaatctccccagcttcccctagttctcccagcccactgctaccactgtggtcccagccgctggggagactctgtcctcactggctcctgggtcggcatttaccctcaccatggccccttgccccctgccctaataaaatggtcagagtggtccttttaaccacaagtctgatcatgtcattcctctgctcctgcctcacacagataaaacccagatcctcagagcggcccatgaggctttgtcaggggtctggcctccttgcctctctggcttctctgtccacgaatctccccccactctgctgtggccacactggtccctcgcttctgtttgaacatgctcctgcctcagggcctttgcacttgctgttctctctgcctttctctcagatattagccagtctccccctctcagggcattcaggtttctgctccatgccagtgtcctcagggaacctcccttgcaccccgacccctcttcctggcttcactttctctctcagcatcagcctcctcctggtacacacgagatacattttgtctttattgattgtcctcgaccacagcatgagctccttagcatcagcaccttggttttggatcccctgctttagactttgagctgagaacagtgcctggcacattacagacacagtaacctcttgaatgaatgaatgaatcaatgaggggtcagctgggaaaccaagcaaaacagagcattccttggagtcccaaacaccaagggaaatatggcacatgaacctcaggatgtccaaaaagccaaaaccagagttacatgaaactatacatttttttttaattttagcacctcccaatctttgttctttctgaagaaaccaattcaggcccagagtttctgccttggtgtgtgtatttttaatcagcctttctttgcctgctcagcagctactggggctcctgggtccactggatggatgccccatctggtcatggagccattttccctttggagaaaatgaggctgacatgagcacttgctgcctttgtcagtcaggaccaagatacacagcaccaaacgtcagccaaagatgagactcctgcaacaaggggctactcagttgaaacattttgtataattggaagatgaggttaacggcgatagggaaaattcaggtggacctacaagggtttatgaagcagatgctgaaaaataaacagatcagggggtgtccaaccggccccgcctgactctgctatttcttggcgagggatggcgcgacagccaagatgtgtgtttgcttaaaatcaagggctgtggaattgggtcagggacttcagttgaaatccagctgcccgttctccagctgtgcgaccttgacaaggcccgcccctgacctttccccagtctgtaaagtggaacaacattcataagaagcgtgactgccttaggggctgctggcgggtccagaatccacaggagaccagacaacttgggggtttctgggccacacacacacagggcactttctcccgcagggctctgctggctggatactcacttgctccagggaagccactcgtccaccccatggggtgggtactgccgctctcctactttccggaggagggaaccaggcatgcagagggagcctcttgcccatggcacacagcaaaagccccagcgtcctgagctcaggggccggccctgtcccactgacaggtttgattctatgaaaggatcattttccctcctgctgttggcttgtgtgatcattggtcactggtatctgggccattccttgagccctaaatctgaagaatgcaaaagtttgatgcccaggcagcttaggggtgccatgaagaccttgtttcccctgacagcccccaaccccagacccagcgcatggtgaactgccctctaaggacccagtgccagccaaaccaaaggcaccgtggctgatggaggccacacaaggggtcattggtccagcctgaggcaggtgacaatgtcacatgatgcaaaaatcacgggatagtggaaaagggaatagggattcaccacaggtcatgatgaaatgggaaaggttcccttgtccccctcacagggcgtggaatggaggactgcggctcgcttcttcagtgccctgctgctcaaacctctctaagggagcatatagatgggcaggttgtggggctcggctccgacccacgatatgtctagagttgaacgtttacagctcctgaagtgccagttggcgtgtagctagaaggctgtcttagtttgccgtctataggtggcttgagttaaccagcacaattacctcttttactttgtcacaaggacagagggttttcttgtatcccaggttcttgccttggtgtacctgaagaatcggatcacacataggcttggagaatgagtatcaagttttattgagtggaagtcgctctcagccgatggggaggccagaagggagatgatcttcccctggagttgggccgctcaggggccctggctctcctctctcctccaactgcccagccaaactctgcctcaccccactggttgatggcttgccagcctgggtgcctgttggtgtgcttttctgctggtgtgctcctctcgatgccctctcaacgaccagccgtttgtgctttcttccactgatgtactactcctcagatgtctggccgcctgtgtgtctgcccactagggtctcgggtttttaaaggccccggaagggggtgtggcaggtcagggtggtcttgggaaatgcaacatttgggcaggaaatgcctttcctcacctaggtccgtgggggtggagccctagccaggtaccacgccctcctatacccagcacttccttccccacttccatattatttaaagggaccatgcacttcccttcccagcacgcctgtatcaatgtcagcttcccctccttccacttcccagaatccaaatatgtaggagaaagaagtggggccagtttccaaagtatttaattaaagggccagtggaagaagtaagactacaattatacaattattgtggttgtttctctttaagtccctgaatttctacaatgtttttccagctaggcttaaagaaaaactccttgggcttaatagaaagagttgcattccatcagcatctctaggtcagcatgtttcctactcttctgagactgttaggatcattttcaatctgtctgaaatcaaattaaaacaagtcaaaactgtgccgtggactctgctctgagtacagtcctcagttacttgcattcatttgtccaggagcacctaccctattgcttgtgggcccctttgagtttggagagcaagttcaggtaccactgttttaggaagctttttctaatggaggttgtgggctccaatgtccttggcacagaacagttgccagacagggagaggtggggggtagaagggacagggggctggggctgcacacaagccccctctgcagtgacagctgtccagtcctaatgaccatctcccagtcctgggcctgaccccctccccaagagtcacctgtgtcaataacagtgtatcagcttctggaagtgattccaaagtactacagttatgactttccatagaaactagaccatattggccaggcgcagtggctaatgcctgtaatcccagcactttgggaggccaaggtgggcagatcatgaggtcatgagatcaagaccatcctggccaacatggtgaaaccctgtctctactaaaaatacaaaaattagctgggtgtggtggcatatgcctgttgtcccagctatgggaggctgaggcaggagaataacttgaacctgggaggcggaggttgcagtgagctgagattgcgccactgtactccagcctggcgacagagacaaaaagaaccccaaacaaacaacaaaaaagaaacagcaaaaaacaacaacaacaaaaaattaggccatattttggtgcacacatgtttctataaacagcttctcacatcacatagggtctagcatcttgcttttcccccctgaaccatatgcactagagacctgtccaccttgctgcatacagatacctcttcccttatactgctgtgtttgtatgtgttaatgtctaggggtgaaactcccagttcatatcccctttcccctaaggatggacacttaggctgtaagtggtcatgagtatgtttgtgaactagttctagttctctagaactagatggtgcaactgtctttctctgccctgcactgaagatagtcatggtcatgggacttacactgaccaatggaatgggagcacaagtcccatgtgtcacttctgggtagaagcttaagagaccctccctgatttgtcagaggccctctgtcctgcctgggctgtcataggagcgtgaagaaggagctgtcctccactagatccctgagtggagatgacgtagagcagaggcccagcctccctgagacacacaagcagcatgagcaaaaaacaactttagctgttcaggctcctgggatttcggtgttgtttgttatcgcagcagcatctcatctaccccagtggatgcaaattcttcctctgtttctccaacacaaacaacgctgcaatgaacagccttctcaacttttccttgacctgtgtgagtgttgcttcaagttagatttttaaacaaaaaagtgtatcgtacaaaactgtattttcttctcaaagagtaaaaataagctttctgctaaatgaaatttcattggaaactttgaaaatgcctgaacttaaatatttaatccatcactacccatttaatatgaagctccaggtaattggcatccattctccacatctggctttttgttgaattaggcacagttgtaatttgtggttagcccagggatggtgaaattttgagtctcttggctggaaaggactcacagagaacctcttgctgagaagagacaaattcagcatcctttccccagtcccctcccctgtgtttatttgtcctgaccataaatgtgcaccctctgctgtgtgtagatctgcagctgcaggaaatggcagacaatcaccttgcagggttttttcctggtctcagaaccccaatgtcattttgcattttgctcccctgtatttagcccaggaagggggttagggaaagtcacaaactgcccatgcagtgaagtcttcaaccttgccaacctttgctcaggcctgtctgcacattccctgcatttatggttaaaacccctttccttttccccattataatttctccctaggaccctaagatggaacaggcctgtggactaggcaggattcttcacagctggtttgattgctcaaggctgagccggtctctgtttggctgcaaagattaactgagctccatcagcagatcaattaatcactaacaaattcaggctgatgagtttttcattccctttcaggccacaggacatgttatagacagactgccaagtcattttaaacctgtgaacattcaaattgcttcagagctgagcctattctagaacgtagcaattttgagcctttgtgcagctctgattcttcataagccgataatgggtatgtggggagcataaagcgagattggatggcttccatttaggatggcagaaatggaaatctgaacagaagtagaggaatcatcattaaccttcacaatggcgtccacacctctagaggtgggaagcaagaacgtttaagcaactgtgctgtttactgggcactcaacttggccagtaagacactggtcaggccagggatatctgggttccactaaaataaagatcgtttccaaatgggtgatgactggcatggctagggggtggggaggcatgggcagtccagagaagaaggaaaatagttcatttacaagtccctttttgggagggatgagagaatgatgaaagctaaggtttgtctagcattggccagaaattaactcccagaaattgacatgatcagcaataatgattattccatgtgaacatggcttctttggtgtaaatttcctaatttgagtttctggcatccattttcccatcttgcggtaaccagaccctagtaactaagcagtcactctcccattgcccatcactgggttcaggaggagctccatgtttggatctaagggtggagcatgtgaccaggtctggccaatcagctggtaaatccccgtgaccaggaagtggttcaggatgagcacgtgacatgagttaatccaagcagaatgagccttggttctagagcaggagtgaccaggagagatgctccctgggacaggcggtgttagatgtccacccaacagctccccaccccttagttccccagtccacaggctgagagtgcccgttccttgctttcccatcctcctttgcagagagggcagagtcacatgacccagtccagccagtggaatctgagagagcatctggtggggtgtggggtgtggggtggggaggtggagggttctgggggggatttgccccatctggtaaaagagatgttcttgacaagaggcttccctttctacctgtattggatgctgttgggtgaatgccacaagcttagagctagggcagccattttttcataagaaagaaaaagtacatatatactcagagtgcttacatttggagttactgaatcactctcagagctaactatactttcaggctccttgtgtaaaaagaaaaaagaaacttcataagtaagctacttttagacaagattctgttacttatattgatgtgtaaacagagctactgggagccgtgttgctatcctattgagccctggaatgatgctatcataaagaagagcaggactgaaactgtcttggtggctttctttgagcccctagatccacctgtacctggaaccttacctctgagttgttccattacatgagccaatgcattttctttttgctaattcgatggtggggggttatgtaccttttttttttttttttttttttaagacggagtctcactctgtcacgcaggctagagtgcagtggcatgatcttggctcactgcaacctctgcctcctaggttcaagcgattctcctgtctcagcctcccgagtagctgggattacaggtgtgcaccaccatgcccggctaatttttgtatttttagtagagacggggtttccccatgttggccaggctggtctcgatctcctgacctcaggtgatttgcccactttggcctcccaaagtgtatgtgctttttataattaaaaacatcaaaacttataacttcggcataacaaaggatggcataaacgaagacaaggaagagctttccggctcatacattacaaaggattaatttaatatgctgtaaagcaacaagaaaaatacagataatttgacagaaaaatggataaaggatatgaatggattgtttacagaagtgaaatgcaaataaccaataaacacaacaaagatgagaatttgacctttaattaaacaaatgaaaatgactattaaattcacctatcagattggcaagacaaacccttcaaggctgtgggtaaacagatactcctattgttctaactaaataggtacgggcagcttggcaggtaacttgtcaatagctatcaaattaaaataagaatgctcagaccttttgtgtaaatcaggttccatgcaggaaaatgggaaccactccaatctgaaaaacagagagcaagagtcagttccacaggtgatggaaaggctaggggccaaatggcagaaactgagtcaagacagagaagaaggaagcctctagcagctctaggcataatgagaaaatgaagaagtgtaactcctggcacccacatctggggtgacccaggagaagacagagaagcacacaggggctcttcagaagctgaagccacggaggaagcatggttactgtttgaggcaaagtaagagaagagaaaagaagtgttcagatcttcacttccagaaagagagtggatacatttttcctcctcttcttgctaagtacagctaaaacccctgcaagtatgtataaaacaaacctaagcctctgaacagtggagagaagaaggcagaccagcagggccctcgggataggagaaatgacaggacagtgagttcctggggttttcttttgccttctttattgtggactgggtgctggagaagctgacaacctggaaatgccaacaagcacagacaaaagggaaatatcaggaagagcctgtcttctctacctgaagggcaagaaatagggcagcctagcaagacacaaaacttttggacaaccaccccatgccggacaaacgacatggaaaaacctcagcccaccctcatccatgccagtgaagagcaagtgaggaacctgaacttccacctccacctagctgtagcaaggcacccaaaccccgactggggtggtgttggagaaggctgggcaggagcctagacttccactctcacctgatgtaaggagcctcccacccacatggtgcccagtggaggctggtgaggagccctaatgagatatcattgcacctccaaaccagggtgctcagagactcgttgggacactgagtcctcacccccacccagcagtaatgcgatgtgcctcccaccccagggtataagtggaggccaagtggggaactggggctccacccaacctggcaataacgaggcgctgttgctgaacccccacccccagtgtggtatgaaaggacgtctgctaacacctggagatttgggtaagatctcgagtctcctagcatgctgcccaacatggcaaggagtccatcaaaaatcactcctaccaagaaccagtagcagcttaagttaatgggaaaagacaagcaacagatgccaacatcaagataacacagatgtcggaatgatttcatagttattttagaatggtcattgtaaaaatactttcatgtgctgaaaatgagtcaaaatatagaaagttttagcgaagaaaagaaaagtttcagtaaggaaatagaaaatataacaaagaaccaagtggaaattttagaactgagaacacacaataaccaattttttaaaaaaatactaaatacctgggctcaatagaagaatggaaaagatggagggaagcttctgcgagctggaaaatcgaccagtagaaatgagttatcctgaacaacagagagaaaatagaaaaaggattgaacaaacagcgctctaagcctccgcaggaaaactgcagaccccggcccccgtcatccccaatgatttctgctctccagaaagcaccactttttatctcttctagctgtttatcattctctttctttctttctttcttttctttgcttttcttttcttttctttcagatggagtcttgctctgtctccaggctggagtacagtggcacgatctcggctcacagcaacctctgtctcccaggttcaagtgattctcctgcctcagcctcccaagtagctgggattacaggtgcctgccaccacacccagctaatttttgtatttttagtagagagggggtttcaccatgttggccaggatggtctcgatctcccgacctcgtgatctgcccgcctcagcctccaaaagtgctgggattacaggcatgagccacagagcccggccctatgtctatatttctaagtaatatgtttctgttgctaccagtttttttctgtaaacattatctatcgcctatctgctatgatcaatgaatatttgcttcatagaggtgctcctctacccattctccctggcccatcaactggtagagttaccgagacttcatgcagtgtccacactaatgtaatggagtaaaaagtcttcatagttgactcgtgtggtgtagactttaattgccttgtttctatagcatttttgctttccctagatataaacgatctacttccacttctttagttttctccatagctgtcactaattcatccttaaattcttagctctgtctataacccatgtctcaatgtgatcacaccctcaggttagggggatggttttgtgtttcactggcaacactcctcggagtaacggctgctctttggatctgcttcagaacagtgatctagacatttccgtggtgcttcagatccatcctggggaccctttcctacatcctgtgtctgggatcccacagcatctccattctagatctgtctctcctttgggtggaacacatcttcctctcacagctctgagaaagggcccaagaagctggttctccatgaccctgcaggtctgcaatgtccttattctgtccttgcccttgatctagtgctccccattccacatgggaagtaaatttcccaagaagtttgtaggcactgctccattcttgcttccagagttgcgttctcggtcttagtccttaatatgagatcagctccatcactctggaggctttgagggttttctcttcttcttgggtttttatgaatgcatgatggtgtcgccagtgctgggtcttttaaaattaattattatggtaccatgagggcccagaaagtacgtctatctgttaattgtgtcattataaattaattgtaagattacaaaaatggcaaaggggaaaatcacacatagcccacttttttttgttttttggcaaaattaagcaaaattagcatggccagattcacctacaccaatgccatcctggactggatcttggaccttggaccaccatgctgggtgctccctcaatgctcctccaaacccatcagactccggagtaactcagacccctgggcatgtcacctgggcagcccgaggcagagcacagctgcgctccccacccctcgtggtcctctgcctgagatggcccctatccgagcagctttgtggatctagaagtagagccagccctttctggctgccacaaaaggaccttccaagcaccttcaaggctgacacgagccccctcccaccttgggatgtgatccctgtcctaccttccattgctgagggcagagaacctctgagagaccaggagcaggaggtcagccagctgcagtagcccctgaaaccacagcccttccctgtgtagccctcacctcccatgttctgtggccagcagggtcttggctcggtgcactcatgggcctcaggaagtcagtcctggactagacggagcctcacagatccacaggcagtgtcaggcttcgtctcccagtcagggcccagtccctgtttttaactttctttgctggagctgcataaataaataaacacacgagtgtgtggacggatcctgccctgctttggattcctaaccccagttggtctgctcccgagttgccaagatctgaatagttaagataagggaaatcctctgactcttctcatctgggccatttgcaggagggcaaacgtccctccctaaagacaattatttcacaatttcttgcatttgtattgatttgtgtattggtatcagccccttgctaagctctaagctccacaacaagtaaagcaatatgttaacagttcatccctcatcctgatccttcccattccataggagaggtcattctttctccaagagtgatctgggtgcattaaaaaatgcaggttcccaaatcccacccctaaatgatagaagttgggccagggaatcagatatctttgctggctcttcaggtgacttatgtgcatatctacctttgaaacactttgaagtagataagaaacagatctatgcttttcttttttttcttttttttttttttttttgtatttttagtagagacggggttttgccgtgttagccaggatggtctcaatctcctgacctcgtgatctgcctgcctcggcctcccaaagtgctgggattacaggcatgagcccccgcgcccagccaagaaatagatctatgtttttctatagaagaaaaaaagactggcccttctcttttggaatttcaactgtttatatttaatgtaattagtcttatcatttcatgataacttcttaggatttgttttctatttgcatcaccttttctcttctttccttgtttattttgcattaatcaggtattttttaaaatatatatatatattcctattttgtaatcttccgtgagtttgtcagtttgacttctagtctttttttttggtttgagacagagtcttgctctgtcacccaggctggagtgcagtgtgattatcttagctcactgcaacctctgcctcctgggttcaagcaattttcatgccacagccttccaagtagctgggattacaggcatgcaccacgcctggctgattcttctatttttagtagaaatggggttttgccatgttagtcaggctggtctctaactcctggcctcaagtgatccgcctgtctcggcctcccaaagtactgggattacaggcatcagccaccacgcccaaccctattattctttagtaaacatcctacagatgacaatatatatctctgatttattggagtctccgtaaaccacaacattactgcttgggcaatggaagagcttcagaactctctaaaatcatttaacctccttctgactgttgtattattcttgtcaaataatttaattctatatataaatttccacagctaatagttactgctgttttgtatactcatggttaatttaaatttcccaatatatttgccctttctattgctcttcatttttattgcattttccatttaaaattatttttccttctaactgaagaactgcactcagtatttatgtgaatgcacatctgctgacaataaattatccatttttgcttatatgaaactatttatatcactttcaaaggatattttttaataaaatagaattttagattgacagttgctttctttcagcatttaaatgtatcattccatcatcttctggtttaattgttcctgttggtgagttagctgttttcttactgtttgtcttttaatagtcatatctgtagttctcagcagttttactataatgtggctaggtatatatttctttctctttatcttgctggggttcttgattctgtgattctgtgatttaatgtttcatcatctttgaagaatcttcacttgaatatcttcatatagcacttcttcctggctttctctttccattctttttagaatttaagttacatatatgttagaccgtttttgttttttgttttttttttgagacggagtcttgctctgttgcccaggctgtagtgcagtggcgtgatctcggctcactacaagctccgcctcccaggttcacgccattctccttcctcagcctccccagtagctgggactacaggcacccaccaccacgcccgactaattttttttttgtattttttagtagagacggggtttcaccgtgttagccagggtggtctcaatctcctgacctcgtgatctgcccgcctcggcctcccaaagtgctgggattacatgcgtgagccaccgcgcccggcctagacctttataaaatcatgctccctgtggtctaatgctgttttgtgcatttgcaattctttctggtcttcatgttttaatatggttatttccagcaaacctgttttctgctttggctaatccgctgttacaccaactgtgttttcacttacagttattctacatttcatttagcaactcttcaagtaattcatttttagatattccatttctctaataaaattctccatcttttcatctttttattgaacatgttaataatagatttaaaaaaattatctgtgatagtctcattagccaatcgtctgtgagttttccttgtctttttttcttatggttttggttatttggtcttatttctgatacgcctcataatgtttgtatgaatgcggggcattctttttaaatattgcatctctggatgatgtacctttccccagggaagatttaatgttttttttttttttttcctgacagctactatagtgaggctagattaccataactgtaaggattcaaggctgatttttcatctttctgagatctgttttatttggtttgttgttccttccctagatcgagtactttgaggtactcaacagaaaccactgtttattttccatggctccaattatttaatgatgaatccctgaactctaagttttgctgctatggcatcattatactggggaaaacctagctttgttttttagcctctcagctgcacagtttcagatgggcttcaaacctctcactctgtctctgtgcaacttaggaatgcataattgctgcaaaaggaaagtactgcagaaaagcagactcactgctagaagttctattttctttaagatctcggggtctcagaccctggctttcttggtagccccaaacatcaagttttgtgtccccagaaccataacttgctgaaaagctcagttcttgtgactcgtagctccccttatttacaaactggcaaactcccaaaagggaaaagaagccgagaatgtcaggcttagatcaatgcatttcccttctctctaaggccttggtcctttaagtcctggcagccaaaattcctccctgatactttcaaataggtcttttcctcagtatactgctagttgttctatgggtctttttgaaagatgagattatcttttcgaaacttgccatctctcaaaacagataagtgctaaatcacatcagttattagggcctcgtgaatgtccaaaatggaaatattccagagatggacaaacacttaagagcacctatgcagagctcccattttttcaatttgtaagttctaagtttatagaaaaatatgaatgttttaaattttggtacctacttactcttgaaacacggtgcttgaaaaacataatcaaagttaagaaatttgaaggattgcagcatggatgttaaagcacagattctgaggtcacactgcttgggtccaagtcctgctttactcctgcctagcaggtgacctatagtaagttatttaacccctcttggtcagtttccccatctctaaaatggaaaagataagtatgccaatctcaagggatgctgggaggattagacaagttaacatacatgaaacacatagaacccaaaatcatgactgctaggaaaacattcactaaacaaatgaaccaaacagtttgctggacagaggccctctctaagctgatttcagcccacagcccaccatactgaagcctctgccctggtccagccctccatgctctacagatagggacaaggggaggtatagaaagaaggggcctgctcaggcattcgcacaggtggttagatgtaaaactggaggtaggactggaattttcttttgatgcattttatcaattaaattgtgtgctctgtaagtgaagtagctaatttcccttgaaggcagaggggtcaaatctccctcaaactatagataattctctaattgctgtgtctgccccaaatccattgtgatcattagcagagacccttgtgctccggctgagagaggagagggaggctcaggctcatgattgctcatctaaatgtttaataatgctccaatctgcagatcactggggcatcaaacctaaattagcctgatactcaaagccacgaataataaggggaatgaaagggataaagtttatttaatgaacatttcatcaatgcagatttctcattgaatattaaggttttggcttgaagacagcatcagagtggagtctgctgtgacattgacctttatccctcagagacacaagtgcaaagtcaggctggtttcactctctgagtgacagcatggtggatcgtcctggcagttacagtgaaggaaggccctgagcctggggtagagctggctcagcccccttcttttcagggggtttctctgcaggtcccggcatctctctccaccaaggctgcccttcccggacctcccactcctcattcaggagctcctcccttcttccagctgtgcagcccaaatcctgggagtcctccctcatctatgcatgctgtcctcttactactgctgttcaatccatccacaagtgcagtcagcctgacctctgtgaagacctgcttagaggctctggtcatgacagtgacagccagcgccctttcagcggcatgcaaggtcacgcacagatccagttgtgtcccctctgacctcagcccccagtgtcctccttgcacatcttcctctagacacattgccccctgcccctcagacacactacacacacctgtccaggcccacactggctgtccctctgccttggaccatctcccctagaatccatgagacctccattccttcagcatccttgccccatgtcaccttctcaaaggtgcctccctgagcgcctgcttagactcctgcccatcccccttgttcccgtcatcctctgcaactttcctcctgggggtcatcagcacctggctccagacattgctattgtttgaagttcatcaggtgctcagcagcaagactggaggaaacagacatgaatagcaaggacctgccaatttctaacaataagtccaccaggagtagtgtcaggccgggtctaggtcctggggacacaccagagggcaaaagagccagagtccctgccatcctgggctgccccccgtgcacccacggaccctggacctccagcaggagggggaggagcctcggctgcagacacggctctcagggaagccctttggcggaggggctgttcgagttgagctctagacagcagaacaatccacccaagtgaagactgatgaagagtgcaaagagtcggagatttccggaaacgggggagggctttgcctccagccagggtgaccgaggaggacagtatgagacggcagggtcgtgtggcccgtgtgatgatgctgggagccgatgcgcattgatccgtgcgccactttacacgtatgttctcttttaatcttcacagccacctgctaatctgttattagcccattgtacagatggggagactgagaggtcagtctgtgcccagcatcacatttctgtactactcagctgttgtcacggtaataccccatcacaaaccatcccaaactcagtgacgcacaaccgccgccacgtctcagctcctggggctgcaggtcgtcggggctcagctgatctgagctggggtcccttgggcttgttgggctccatcgggggactctgcttcctgctgagaggcacgggggctgggccccgggatcaggttcccgtccaccctgcggagctctcctcagcctcagggcggcggctcctcagggtccttttgtagtgaatgacagaagcccagaaccaaaccagagccccaggcgcatccccagtccccgcctgcatcagaaccacaggggctgcatgtccaaagcaggtcactttcactgcacagggcaaggagggggccctgggacagcacagggcaagagaagggggtgtgccaacctatagcagggagtggacagctgggaccctgacctgctgagcacaggcagatggggtggtgaccagctgggccctcacctgggcatcgggctctgcaccttcacccacatccgccctgtagcctcagtcatgggaggggtttggatgctaatcggggggtaaggggaagctgtcctgggttgaagagtgtcccctgcaagttcaggtccatccagaacctcagcgtgcatcttagttggaaacagggcctttgcaaatgtacttagttaggtaaaactgaagccacactggattacagtgggtcctgggtgcagtgatttgtgtccttgtaagcaggccgcgtgaggacacatggggaggacatcatgtgaccacagaggcagagatcagagccaagcatctgccagccaaggatcccaaggtttgcagggaccgggaccgcgggagcttgggaggaggcggggaacagtttctccctggagcctccggaaggactgaccttgccaataccccgactccagctttctggcctcctgaactgtaaggaaaagtgttctgatggtttcagccaccagtttgtggttgtttgttagagcggacccgggaagctaatacagaagccggaggaagggcctcggccgggaacacacactcggacttgtctttggaaagacctcaggccccgagggcggtctgtgaatgtttctgtcggtaaattaaattcttgagggttttgccttggctgagtccttgcctatggcctcccaagagttgaaggtcacatttggggctcacccacctttcagccccttcttatctcctcatcctcagggcggcatttctgttcctctgttaatccaaacaacagctctgtctctcataaatgaggttgccttcagtcatttgcattttaacaaatttgtgccttttgtccctattttcctaggcaatgagtcaaagagcagaagaagccccttcaccctccagccacacatcacccttacacacacaacagcacaaagtggggccctctcccatcagagcagggagaagacccttgggccttgggatgtggagcaagtcacttttttctcctcagcctcagtttacccctttgcaaatgaatgggtttgcctaaatggcttccaagggcttctcctgaatccaacattctaggattcaaatatttattgtagaattctcagtattccattctctgagtctttccctcatccaattcttcagcaaatcctcatgcagagctcactctgccacaggccattttcttacttagagcagggatccagcagcgaacagacagatgaaattccacactcatgtgggtgacattcctgtgggtgcaaatgacaatagcaaaactgcaagagagggcatcaattccagatggtgacagtcctgtgcaggtcacggggacatggcgtcggagtgcagagggcttccttgggaaggtcaggggtgttctctgagtgggtgacacctgggtgaagaacaaagggcaagagggcgcaggtcagagggcggctgtgggaagagcattccaggacgcaggagcagcaggtgcacaggccctggggcaggaggactggggcgtgggaggaggagccagaggccagtgcggctgggatgggggagtgaggggaggtggtgggaagtgatctggggaaccagcaggactctgctgggccttgtgggaggtgatgaggaggtggagtctgctgttcccagtgcagtgtgagccgctgaaacatccgctcagggccacatgaccattttcaggagctcactctgggtgcgtgtggagagtagatttcaggcgtgggaagaggagtgggagcaggaggtcccatgggggctgttgtaatgacccaggtgaggacagaggtgcagactttgggacagcagcagggtgtggacaggagtggacagacggggtgcattttcaattcaatagattccatggcagctggaagatgagggagggcctgaggatgctgcctgctcactggcttgaggaaccgggcgtttggtggcgccaccaactgaaaggggacactgagtctttggtggcttcattgaaaacttgccagatatgaaagcctgagacgctccgataactgagcctccaggctgtcctcccaagggccttctggataggaggccatgggtacaaaggaactggcatcctggttcccatgtcccaggcccaacccagggactgagccccaggaagaccacagagcagcacaaagcccagatctgctgctgcctgggcagagccaagcccaggatttatgaaggaagctggcaggagcggaaaaattccttcgaagattgcctcactcatcaccatcctcggtggcaccctcaaccacaggatggagaatcattagaagatggcagtctcatagggtccttcaaaattaccacttgcatttgaacaaagctgtgctttcttagccccaaccctccccataagcctgggctatcaactggagataaatttagctgcaaaaaaatgtcaagattcagatacccagcttaatcaaggacacattcttcattcctcggactgttgtacttctcaggagaccccagggattgcatgagagactgaatcatcttgtaagtgaaattagaaggaaggaaggaaggagggagggagggagagagggagggagggagggagagagaaggagggaaggagggagggaaggaaggaaggaaagaaagaaggagggaaaaggcaagaaaggagaaagaggactctgaacattcagataacaaaagatttacagatctgttctgacgttctgttgacggggcaccccatgttcagccagttttgcctgtttcagtttttgtgacgagtgctccttgatgttggatgttgggcacaagagcaccctcctaagcatccagcctctgtctactttttcccttttgtgggcactggtaactttctcagatcagcactagaaactcccctttggctaaaataattaccaatgtgaaaataactgagacagggtagccctaccacatgccagtttgcaatgctcagcacgcaccaacccgttcgtgcttcccaggacctgtgaagacagagctgcttttagcccactctctgctggggaagcacaggaggtggggaactttcccaggttagaggtgggccctcagggcaggttgtgtccccagggccccctcccacaggcctttctccaacaaagcagcccccccatttatcctggccagataactgattccttcctggttggccttggtctttggaggacttgcaccgagtttgccaggagggtgggactgactgtctttggtgaattcatggggagttccagatggagccagcccctgggaacctggcaaagcaaagcttaggtttcctggtaggggaggcccagagaccatgtgctccccctgctggggcctcgtccaccagcccccagacagccgcctgctctgcaggacccaaagtcaggagacagaggtggacaatccatgttgcctcttaaatgttgcagccacaaggcaagaggtcctcaagatgcgtcccagcaaaatctagagatgaaagtcagcctgtgtgaagagtgtcaggaacctactatggggtcattgtacattttccctagctaaaaagaatggaaaccaaaaaaatgaattataaatagacactgtagggcttcttttattattacacatatacagtttcacaaagcagtgagtcacccttattcacattaagcaaagttccagcttccatgaaaaggtcatttttctatgcttttctaagatcctgcctgaaggtgcctgtttctctcatgggaaggatgcaatgctgcctctcaccattgcagctcctgacagcctatgaatgcccgaaggccttttcctcctctgtgatagacacattgtgatatggattttcaaggtccattttattccttccagaagaaaaagaggcttcataatctcagagcagatttgtcatatatatatgtgcgtgtgtgtgtgtgtgtgtgtgtgtgtgtgtgtgtgtgtgtatatatattcagaggttattggggaaagacataggaattgcttttttctttttaaattgatttttgttttgtggcagcaaactatgagatgaacaagaatgagcataaacctaactctaaaacagaagaaaaatcactgatttttaaggagaagtgcaaatagtaagagaatgcatatcagcatgcgtttatgagttctaaatcttgccaaaactaaaatcgtttttaagaaaattttttaagcattgttacaaacattgaatgcatcatcttcaaatgtctttagtagacatggaggcatgggagaattaaagccagtctttaggaaggaataaaaagctacactaaagttaattattgatctcacaatggatgagaagaaaacacttggattataaaaaggaagcccagacaaaataatatcactttgtaatgtcgaaaacttaagattttaacttttatcttatgtatctgtttctgatgaacattcataattatacatattgtatttattttctttgtcttataagaaaagataaaggataaagagacgaatgtgtttcaggcgtggttcagcctatgaagtctccatattcataggaagccactggatttatacaacatcaggggatcataatgaacaccacggtctactctgagtcttgcaaaagtgagaacaatgttaaaatgaaaaccccaattagcctgaattaagaggcactattttgttctgaccagagaggattttctctgtgtggtcttatagttgaagtctcctaccagtaagttagcatgtattggagaatctaagatctttcccaagttggtctgttttagtcagactgtcctaattccaactgatggcatctaaataaaaatttatcttattaaaaaaggcataatgaggagtaattggctcatgtcattaaaaagtccaagagcaatagcttcaggcatggctggatccaggtactcaaatgatggtatcaggaagtgacacccacccccccacctcctagctgtgacttgttctctgtgaatcccattctcaggcaagctcttctgtcctggcacctattcacatcctcaggagctctgagagaaaaataaattttctgtcccacagtttcaacaaaagtctcagaattgagtctcacatgtccacctatgatccaatctctgtccaagggcatagaattttctaatggctcaaactcactgctgttacagcaaaagatagcaaaagaacccagactcaagcttttcaaacaatgttttgctgtttagaagagccatgctgcaggaaggaaggaggacagagaactcaccagttactagtggcttttcatgacctggcaaaacaaggaggtgacatagcaaaacaagcccattcagattgaatgacagggtacctagacccacctttcatgggaggagtgtttaaaaccatgcagcatgtttttaaaaccaccatagttggtagtcagctcaaaacacatcctagattggcttttcctcttcccgcattttattcttgccagtcccccaaatccagatcctgggatcatttctgggaaataatctacctgctcttgtctcaggtcctgcatgtggaggatcccaggcaaagacactgtccatagccccttcaggcttatcggatatggtttgttttagatggaaatgagttctatactgaacctgcttcaggtggaatttgtgattatccttgagataaaggaaattcacccaggggtaaattccaacataaacacatattctgctttctttcaaaagactactttaccttctacttttcccatctcttccattaatggttgcctgcattccctgaactttgcataattggaagagctctttaattatcttttaattctttctcaattttcagatgcattagcatgtataaaagggagatgaaacattgctcccccctttttatttaactttataatccttttgttacaacgtggcagggtctggtttgactcaaattacacatctgagtagctcattaaaaagaagttgcctgggagtttgaatttgctttctctgctgagtcactttacctccataaacctcagacaaataaagttcagaactggaggtcgcatacaatgctggtttatgttaaagtattcaccatttacctgggtcatacttaagccttgatttttttccctttcctaaaagaagcaacctgcgacttttttgaccagaagaacagttagcatgcttaacatctttgctgatttaggagttatttcaaagaggtcttctggttgatttactttatcttacttaggggatgctattttgttatctttttaaattttttattttagagactgggtattgctctgtcacccaggctggacagtggcacaatcgtagcccaccgcagccttgaattcctggactaaagcgatcctccccattcagcctcctgaacggctgggactacaggcatgcatcaccatacttggctaatttttaaatattttttttgtagatacggagtctcactatgttgcccaggctggtcttgaactcctggcttcaaatgatgctcccgcctcagcctcccaaagtacctgaattataactgtgagccactatgcccagcaaagctgtttttaaaatgggttttttcataagttgatgatagtgctgggacaccccaggtcatgaagacccccaaagctcctcaagtagacaagtaaagcacaagatagactgtcgccttgctggttggattctcatacaaccaaatggcactgtgggttgagaggatgctatcttgtttacatgtcagaaaacctgaagtttatcaacaacatcaagttggctgtttgctctgtgcctagacagtcttcttgtatatgtactgtatacccaataacatataaacaattcatctgtttaatactttcaacaccctctgaagaagatattattttctaccccaagcacaaacaggagaaaacagaggccccaagagctcatgtaactagcttgtagatggtacaacctcatcttgaacctagaactccaactccagagcttgggccaataaccatgcatcacctttgcaagggagtcttctagggtgaccagatttagcaaataaaagcacaggatgcctgcccagttacacaatgaatatctaaatattgcatggtcctggaatgaatctggcaatcttagattctcctggctgaatctccagtgctgacaacatggcccagcacagagtcctccacagatgaccagagacaaagcaggaaacgtggcccgtgggactgatatcgtcaccatgagacctgtgaagagggtgacgaggcacaccaagaggacaaaaggaacaggttgaaatgtgtggctacgtctagaaggaaaatgataacaggcatccttgtgaagagacactggtcatctaaattcatggcacgtctgcatagcgttcaggaaagtgtttcaaaaacgtcctcaaaaattttccctatctataccccacttgtactatgttttacttttttctttaatttgactcactgttttacataaataaatatattcaaacagaacacttgatatcaccactgtaaaagtaaaactattatcatttgctgtaagttgaaggttactatatgatatggttcggctatatcctcacccaaatctcatcttgaactgtagttctcataatccccacatgttgtgggaggaccctggtgggaagtgcttgaatcacagaggcagctacctccatgctgttcacgtgatagtgagtgagttctcatgagatctgatggttttataaggggcttttccttcccttcactctgcacttctccttcctgccaccatgagaagaaggacatgtttggttccccttctgccatgattgtaagtttcctgaggcttctctagccatgctgaactatgagtcaattaaatctgtttttttatagattacccagtcttgggtgtgtattagcagcgccagaacagactaatacactgtaaggacatatacataacttaaaaattgtccaaataggccaggcacggtggctcacatctgtaatcccaacactttgggaggctgaggcaggtggatcacctgaggtcaggagttcaagaccagcctggacaacatggtgaaaccccttctctactaaaaatacaaaaattagccaggcgtggtagcaggtgcctgtaatcctggctactcaggaggctgaggcaggaaaatcgcttgaacccaggagacagaggtggcaatgacctgagattgcgccattgcattccagcctgggcaacaagagtgaaactccatctcaaaaaaaaaaaccccaaaaaacaaaaaaaaaaaaccctgtccaaataatgcctaaggttatttttcgtgttacagtgaatgggtactacccatcaggaaatattggttgaaataagggacattatgcatataaatttatactaatggatacaaaaatattcattttaatatattaatttgactccttaggaaattcatttataattttaactctgttgagctattcttgaataatcacttaaaaatcttaatgagagaaaatcaaccagccagaaacaactcccagctgagccctgacaaacccatatggcagtcacttccagggctgggttctctttaatgggtgttataggagtggttctcatggagatttctgttactttagttcaaagccgctcatgccatgaattgcaaacaattgaagaggatcagttatgaatttattttgggaaaggccttctttgttgaagatacactggaggcagatttttgtggcatatccggtaattgatactaatcctgcatgcctctgtaagagggttatacactgtgaccttttgtcatgtacctctgcagggccctcccacatgggcagagtggatctcccaccccatacactttgagcttggtcatgtaacttgctttgagccatgtgagaagactttgcatagaatccacctgagcaaagcttgtacatccgacacaaattgcacatgtaagtatttcttcaagcaattgttcctcttctagccaaggtcccagaacaagagaggcacaaaactgaactgagatcattttacaggctgtagccaagcccagctggtctgcagcctgagccaacatcagccaaacccatctacactataggctcttgagtgtgaaaataaacatttgttgttgtaggtcactgaattttgggttggtgtgctacatattaccatgatggcaaaaactgatatatctctgtattttaaaactgagcccttctttgtctgcatttattggaaatgggctcctaagaagtatctcatgctgtggatagacaaaggcactaggtcaggggcacattgagagaatggttttctctcgccatcaatagcagaaagcacaggtcttcgtggttttctcagtccttctaccttaaagcaggtcagccaagttcaccacccttgagccaggcagtgtccagcaacctcctccaacagtggatggcccaggaagaagaagagaataaagaagaagagaagagcacactcctgagctcactcctttcatcttcctgctctttgatttcaaagtaaataacttgtgaacattttcaccccgatcatctgagataagatggagatgggtatagaaatgaatgtattgattaggcaccattcacagacctgctcccttttttgtaagaggctgtaatttgagcgctctgatttttcaagtcagtgaaatgctaaatggaagcccatcagccagtataaaagagatttccaaaataacatcacagggaaaagatcttttgataatatattcctaaagagttttaagctacataacattttctgcccctaaattggcagctcttgcttccttcgctttccagttttccagatttccatcccagaatgttttttatgttgcaaaacgtgcttaccacttacctccccaccaggcggaattgtctctttcgcatattgcagttaattttaaacccgagatgggtgacttcttcactgctgagtcactggaatgggaatggcctgatgttcggcatacatgtgggcagagatatggggtctgttagtagaaaagcaacactcagcatatccctgaagagaccaaaataacagacaaatgaatctctgctgctctccaagaaggatcttcctttagtagaacttttcccaaaaacagaaaaaaggagtctttctggccacctgtcaaaatctagacaagtcaagaaataagtgacatgcaaaggactaatatccagaatctgcaagaaactcgaacaaatcagcaagaaaaaaaccaataatcccatcaaaagcaggcaaaagatatgaatagatatttctcaaaagaagatatacaaatggccaacaaacatatgaaaagaggtccaacatcactaatcatcagggaaatgcaaattaaaatgacagtgagataccatcttactcctgcaagaatggccataattaaaaagtcaaaaaacaatggatgttggcatggatgtggtgaaaagggaacacttttacactgccggtgggaatgtaaattagtacagccactatggaaaacagtatggagattccttaaagaactaaaagtaggactaccatttgatccagcaatcccattactgggtaactacccaaaggaaaagaagtctttatatgaaaaagacacatgcacacacatgtttatagcagcacaatttgcaattgcaaagatatggaaccaacctaaatgtccatcaaccaaggaatggataaagagaatgtggtataccatggaatattatgcagttataaaaaagaatgagatcatgtcttttgcagagacatgggcggagctggaagccattattgtcagcaaactaatgcaggaacagaaaaccaaataccgcatgttctcacttataagtgggagctgaatgatgagaacacacgaacacatgtgaaggaacaacacacactgggtcctgtcagagggtggggagtgggaggagggagaacatcaggaagaataccttagggatattgggcttcatacctaggggtgctctgtgcagcaaaccaccatggcacacgtttacctatgtaacaaacctacacacctgcacctgtacccctgaacttaaaataaaagttggaaaaaaaaataaagtatggatttcatcttaaaaaaataaaataaaatgtggtatatatacacaatggaatactactcagccataaaaaggaataaaatgatgtcttctgcagcaatttggatggagctggaggccattattctaagtgaagtaactcaggaatgaaaaaccaaatatcattatgttctcacttataagtgggagctaaactgtgaggatgcaaaggcgtaggagtgatataatagactttggggacaaggggggaaagttgggaggggctgagcgttaaaagactacataccaggtccagacggggtggctcacgcctgtaatcccaggactttgggaggcggaggcgggtagatcacgaggtcaggagtttgagaccagcctggccaacatggtgaaaccccgtctctactaaaaatacaaaaattagctgggtgtggtggtgcacccctgtaatcccagccacttgggaggctgaggcaggagaatggcttgaacccaggaggggaggttgcaatgagccaagatcgtgccatggtactctagcttgggtaacaaagcaagacactgtctcaaaaaaaagaaaacaaaaaacaacaacaaaaaactacatactgggtacagtgtacactgcttgggtgatgggtgcaccaaaatctcagaaatcaccactaaataactaattcatgtaacccaaaaccacctgtaccccaaaagctattgaaataaaaatttaaaaaattaaatttaatttaaaaaatttctcagaaaagaataagtgtcatgggaacattttagaggttatgaaagaaacacaaagagaagtgtctctcttcagggaaccctcaagatgtagacagagacaagattttaaaatgtacaagaaggacgtatgtgtgatgtcacggtgccagatgaacatgctaaaaattccaattccctgagtctccatctacagaaaagtgcttccattataaatgatgcattttgctgtggttatacccgcgtcttctgaaaagtatgtgttttaattaagtattcttccttctcctgtagatgttagaattcccagtcagtctaagttttgatggtccaggcatcatctaccaccgctcgagccgaagaataagaagtcctcaatcaattttggttgacaacctagcgacgctgggaagcctgggaagacagatctcactttgggctgggagggttacaaagaaggggcgtcttcattttgtgaggaatcgtaatgttcccttgcacatgggctgtattttctcagaagctgacactgttttcgggcaggaggcccatgcatgaaatatgactcacacttcgtatcacagctgagagtgaccgcagtgtgaacctaagatcagttctcaatttgtacctggtcagatgcagctgctggaaaattcccagtccctaacagtctaaaacgattcgtaaactcaaatagagagaaaagtggaatcatccttcaatattactatctggactccccccagctccccgccacacacacaaagcctgccaggtctccacactgcgttcatctgagcagaatttacaagccccacaaaggagaactcaggccacgacagctaccgggcaggggacacagatgggccaggcagttggtattgtacagaccttggcaacaagagggtgtacactgaccaaaaattaatgcatcacaactagattattagaataacccatgttcacttcacgctgagcatgagcccactcattgctcctcagtcacagcttccctccctccactccctcatcacaaacctctctctctccttaaatctcctcctccctgcctgctttaccagggctccaaagctccctctcctcccctggctggtacccgatgtgcctgcagccaggggcacaagtgtggggacaaggtgcagatgcttcagctggtcattccccttctccctctccaatacctggaccccttctctgcctggggctccctgtcccagaactggcccctgagaactgtatctcctgggctccctgccctctggcattcagttggggttcagcaaaagggaggctcccctaaaggttaaggacaggaggggaaaggttggggtgcctcttctttactctcgctgtggtgtgaccgcagccctgtgggcagccccttccctgcaggagtttcccagggttgcccatgcactcccctccacctgcccctccagccctgggctctgggcagctccctcacttgctggtccccaggtgctcccagtttccttaattctgccccaaacccctgccttgcatgcctgtgtttcccaccgggactaggtgcgaaagaatctgctagaccagagcccaggaaacaatcaggaaccgagtcgctgacccaaaggaggctcagcagagaggaacctaagtctgcagccctgggtgctgcgactcttcctaccacagaaaccagcaacgccgcacatggccacccacatccccagtcctgcgcctgcgcctcattggccctgtgcacacatcgccacggggtgccccacaccacaacctgccctgaggcttggctcctgcagctgaaccaggctacagagcagcagggaggggtgcaagctctccttggaaccctggctcagccccttccaagctgtgtggctgtagggaggttatttgccctctctggcctcagtctcctcccctgtaaaatgggtggcatgatggacctgcctcgtggggtgggagggggcttcagtgatatgctgcaggcacagtgttcagatccaggcctgcacaggacgggctcagtaaacccgagctctggggattttcctgtgcctgggatgccctgcccagcttgcctcccgcagcccaggcctctctgtagactatgcacactgcacaggtttctacccttccgtattcaatctgccctctgtatctgtgggtgggttccacacccatggattcaaccaactgctgatcaaaaatgtttgaaaaaaaatgtgcgtctgtactgaacatgcacagactgttttccttgtcacgattccctaagcaataccgtataacaactatttacatagcagttacattctgttaggggttataagtaatctagagatgatttaaagtgcatgggaggatgtgcgtaggttatatgcaaatactaggccattttgtattagggacttgagcatctgtgaattttggtatttgcaggaggtcctggaagcagtcccctgtggatggcgagggatgactgcatatacattttcctcaagtccccctgcagccctcttccctgcctttaaggaaattccatgtctcccaggcagtgtccacacctctgcctcaccaccactcaccccggccctcccactgggcttcccagccctgctccccagagcctttcctgtggagctccctgtgctccccacaaggacccgcccagtccctcctgggtgtctgcagagggtggccctggggcctctttcctccttgtctcctctccttcctctctccacctagccaggccttctcagcaacttttgtcatctcatcctcctgcagggggcctaaatgcgggtgtccctcaggttccgtggagtctgccttctcattcgctctgttccccctcctgggggtctcagccacccttgggccacagccacacaggggactccttagccacaccagccaaccgctctcctggcttcagacctgcaggtccacatggctgtcccacggcaccttcaactcagcccaataaattcacccccaaacgtaggctctttgggggtcaccacctcagtgactggtgaccccgtccctccaggcccatccagaaccctgggcagctctcccatcccctgtcccttcctctccctctcgtctcaaacccaagtcctactgagttgactgctaaatggctcttggctctgttccattccttcttcctctgctgtcaccctcctagctcagctgaccgtcctctctcacccacatgatggcttcacccacctcacagaccaccctggccctgggcagcccctcctccccattccccataccatggacagagggaccttctggccacatcacatccctgctaacctcactgaggtctcccactgcatttaaagacaccccccgtgccacaacatggctggaaaggccctgcactgtctgctcctccagccccaacccctgccttcttccctcgtcatcctcaccccaacgctgcttaaaccccactgaacttcattcagtttcttcactctgctgctccatcttgcctccaggattttgcacgtgcagttcccctgcctgggactcttccctgctcttttcatctgcctgagtcctcatcatcacagcagcacaccctcctggaagtctgtcctgggtttcctgctcctacctgctcccataacacctgagctgcccaaacacacagataagccctgtggtgtcactgctgggtgctttctcatttccatgagcaaaggacggtgaccccctggcccactgcccaggacagtgcttgacacagtgcggtgggaggaggtctcagcaagtgtctgcagagtgaattaaagaattattttatcctctgggctcctcagctggatcacgagctcctggggaagttactgggggcaacactctccgggctcccctcaacagctcacagttcgcaaacatttgactgagtgactgagtcagctcaggccctgcagtctctggctgtttccttccaatcgtggtgaaagtcaccctcgaaggcagccctggggaggatagaaggcagcgccttcccgtcactgagcccatggcaatcagagcccaatgtcaccagcgactcctgtgaaattagcagtgacttcacgcgttgagggcatggggcaaatgccaccacctgtcggtatttccatcgggtctacacccaagaaagggggagatgctgcctttctgaagtaggttgtgcctgaggcggcctcagcagagaggaaatgtgtaggcgtccacagccagcccagcctgctcagaatcgcacccacactgaagttctggagttggtggcagtgattcctcctccagcttcccagagccttggagtgcacttaggagatcagcgaggcctctgtgcactgatggaagctggcttccccagaaatctgctggagtgagggcctgtcaggggccctcctggccgacgttgaccaggactggcccagggaccaggtggacacgagggcaatgatgtcacagctgccccgacggttgatgccccgtggcttgccacggccgtggccttggagacagggtctccggcgcagcgcctcagctccgcccatactcgctccgccctggtgggctccagcctttccctttccctggggctcagcctcccaatcagtcaaatgggcagattaacacccatggccttgactccgtcagagactgggggaagaaatcgtgagtcagggcagcgaggtctgcggggagcgttgtgaaggtgtgaagtgctgagctcccaggtccctggctgccaccatgggctcggagccgcgtggtgagttcgctttcattccttaaaaacaggcagccgctaagtggagaaactgggacaccctttgcatcttctcaatcttagttcagtgctgtttccaataaaccacggctatcctttatcagggataaagtcctttggatcatccaacttcagcttggacagagtttcctgataaataacaacaacaatcatagttgcctgtgtttcccagaaaacaaagatgaggcaaaagcttatgtgctttagcacataaagtgcattgttggaagagtgcattcccaggctgcaggagtgaggaaaaaggagaaggaggcagaaaaggatgaaaagaaaatacaaggaagcttctatcaagctgggcacagactggggacagcctcaatgcacggtcttgcagaacgttctcagagatgggacaggagctgctgtaggttcagtctacctgggaaagagggagagggatttgctcaccaaatcccatgtcccattcgtcaatgtctgccccacgaggtattaatttccagcactcccggagctgcctgaatgtgggcccccaagggtcccttggagttgagatctcaaaggtaacagggaatccctgacatgtgccaggatggtcctctgccagaatcccctcccgcaacatttcccctgggtctggagaagcctaaggaaatagaagtgggaggggccagccctcgaagcctcattaactaaggcttcagcgtgggacagttactatttcatctgatggactcctatcttaggacttcaagtgccctttcttttctctcctcctagataactagtactcatgctccaaggcccagctcagatgtgatttcattcctgacttttcaaggcggaattctttacattttcccctggggcccccacaacacttggcttacccctctttatggcattgtgatggacactgccatgattttgcgcatcaagctcctgccttctgttaaaatggctgggctttcctttgggaaccccctcagttaatcagatgtgagtgggactgatttctccaccacccctagtcaccccatccagagagtggaggtcattggcagagctattccaggaccaggtctggagactcttggtccacgttaccatccatctcatctcaggctgttgatttgtctatgggtagttatctcatagttggtacaagcaatactgttgcttagctcacctatcatctgttcttaaccctctctccctagctaccttccagctaggcattgcaggaaacagagtcctggacaatgaaatataagtagaagtctgctgtgggtttcctgaaactgttttgctttcttgatttagtcactgtcttgccctctcttccccatcttcctgcagttgatgtgatgggtatgatggatgtgaaagatggagcagcagcagccggtttgcagccttgagggaaaggccaagaggcttgtggaagtctcggtgatgccatctccaagatgctgaaccacgaccagcaatttcctaccccagatttctcaagatttgaggaaaacagttatgtaattaagtttctatagctacgctttctgttcctggaagctgaaagcattcctgattaatgtggttagttttctgttcaactagcaaacagtacagtggtaatgacagagtcctagactatctgggctgaaaggaacctcaaacagaggtcaaccagtgacctgtcctttcatttcacagggacgaaaagggacaggaaaggggtcctttctggggtgcttgtccagggtgcttcagggagagaggggtggaaccaggactgttttctgcatttctcagcagctcacggttgctttcaccacacctcactgatgtgtgctatcttccaggcaataatgacaagagccaccatttacttattaggccaggtgcagattaagtactttgcctatatcaattcattacattctcaccaaactcctccaagggagacagtcttgttatcatttgcatttatgaggatgaagccaagcacagagagatcaagtaacttgtccaagtatccaaatccagacattgtagtgatgatgactccaacctcaggagtctggagcctgagctcccacatggaaccactaggctgtactgcctgggtggggtttcagaaatgctggtataagattccaggctggtaggagcttcttagggtgagacgagtaggggcaaatcagcagggccacctctctggtaaagtccttggggcactgcttccgggaaacacaatgtcagtggtgccactgggctgtccaatgtggtggccccagggttttgtccctgcaagtgtcacactgtgagttcctcaggaactagatgacaacataaacaaatgaagccaggtgactatagtgaggggtgtggaatgaggccaattggggagcccaagcaccttctaaaggagcatcggcccctcagcttcagcctctgttactgtgggaaaatatgggtccacattttacagttttataggttttcaatgactgcctcaaatctggacctttttctctctctctgctttaatttaatttaatatatctctcttggttgtgcatcatttaattttattcttaggtaatttttttattgttatgtcatccatataccctaaaattcaccattttgaagtatgtagttgaatggttcttagtatattcacaaacttgcatagccatcaccactatctcattctagaacattttatttatttttatttatttagaagtggagctttcctatgttgcccaggctgatctggaactcctgggctcaaaggattctcctacctcagcctcctgagtagctgggattacaggcacaggccactgtacctggcttcaattctagaatattttaatcatccccaaaagaaaccccacattcaccgggtacagtggctcatgcttgtaatctcagcactttgggaggccgaggcgggcctatcacaaggtcaggagttcgagaccagcctggccaacatggtgaaaccgtgtctctactaaaaatacaaaaattagctgggcatggtggcacacgcctgttgtcccagctactagggaggctgaggcaggagaatgctgtgaatgggaggcagagcttgcagtgagctgagatcatgccactgcactccagcctggtgacagcgagactctgcctcaaaaaaaaaaaaaagaaagaaagaaagaaaaaaagaaaaaaaaaagaacccccacattcattagcagccatctcccattcctctccccacctcccagccccagcaaccacttacctattgtctgtctttatgaatttgcctgttttggatgtatcacataaatgaaattgctcactatgtggccttttgtgactggtttctttgacttagcataatgttttcaaggttaatctatattgtggcatgcatcagtactatattcctttttatggctgtataatgccattgaatgggtataccacatttaaatctgttatctattacctatccatatttaaatatgttatctatctgttatgagttattcataaaatgatggacatatgtgttgttgccacttattggttattatgaacaatttgctataaacgtttatatacaagcttttgtgtagacatatgttttcaattcttttacgtatatgtctgggaatggcatatgttgctagatcatatgatatgtctatatttaacattggaggaactgctaaactgttttccacagtaacagtaccattttacatgttcataagcaatgcatgagggtttaatttttccacattctttccaatacttgttagtgtccatcttttctattacagccatactagtacatgtgaaatggatttcattgttttaacttgcatttctctaatgactcacaatgtcgagcatcttttctgtgcttagtctccatttgtatgtcttttcagaaatgtattttcaagtcctttgctgctttcaagattttttttttacctttgtcttctgacagtttgattatgatgtgactagtgtggatgtctgagtttattctacttggaggtcatcgagcttcctggctggtttttatcaaacttgggaatttttttggctagtatttctcagtgattctttccttccctttctgtccctcctttcctcctaggacacctattatgtgtatgttgtcacacttgatggtgtcccacaggtctctgagctctgttcacatctcttcattcttttctctttctgttcctcagaccgtattatctcaatagacccatcttcaagttcattgagtctttccactgcctgctcaaatatattcttgagccccttctagtcaatttttatttctattattgtacttttcaactccaagacttctaactagttcttttttatattttaagaataatttctgtatttttattgctattcttaatagcaaatatcatcttcctacactctttagttttttaaacatggttttctttaattctttgaacaaatttaaaatgactgacttaaagtctttgtctagttaagtcctatgtacggacgtcctcagggacagtttctattggctgcttttgtttcttgtgtgtggtatatactttctttttttattgcatagctcatcaatttttttgttgaaaaatagattgtttagataatattttttggcaactcttgaaatctggttcttttcctcccccagagtttgttgctttttgttttttgttgttcatgatgtttgtttagtggcttttctgaaccaattctttaaagtctatattccttgtcatgtatggaaacaagtctctgcgtgattgaagaaagacttccttaaatgcccggaactaatgtttccagtctctgccgaggacctctatatctcttggggtatatcttcactctcaggcagttgacaactctggcaaagccttcacttcttgcttgagcacagctttaaggccagccagaggtgagagtttaggaccctctcggttctttcctgagcatgcacacagccctgcacatgtatgtgcccttctagattaagaacatgggaacttttcagatccccctgtgggcatctaactccctggatttcacatttatgctttctgattagtctattgtttgccccaactattactaccactgtaggcagctgaaatgctaaacaattgcctctgattgttttggcaaatgttgctgggggaaaaggctgtttatgctcattaaaaatcaagtccagtaaagatagccttgagactggggtttttcagggaaccaccaagcagggaatggggctcagaaggaactccaaccctgttctgatccctctagtagttgcctggctgctggttctcaccaaaattgtgggctattggtttttaaaaagctgggacaagggaggtgataattggattactttaaaatccataaattttgttaatcttaacaagattcaaccatttttgttaaataaacatccctgggttgctgcaagcctctggttaatttcctagagttataaaaaaaatgatttggacaattttggcagtttgctcactgaattgatgaaggagaagattttcaggtccttattctgctattcccactgatgtccagatcatttacgttaaatacagtgttgcatcttatttttaaaaaatcagaaaactcttgggtgggccaaagaaaacttgtgcaccggccagatatgccccaagcactgccagtttgcaatctgcggcttaagaaaccatactttttttctcataagcaattgctttctcttctcagaattgtaggttactcagatgctactcagaggggccttaaagatgttcagttctaagcccatcattttagaggaaaaagaggccagagatgagcagggtcttaaccaatggaacagagctgatctgcaatttctgaaggtctccataaaagctgtgcctcctgaaaaatggattcacaatcagcaacagggagtaggagtgacctgcttgcatcaagaggattgcttattttgattgtggttaaaactacagtcttgtagtttgtttattggcatttttcctttaaaagcactccaggagtctacggtgatcagcaatagaaagataattaaattgtgattttccccataataggccagtataaaataatggaatgaactaaccacaactgcacacaaagcatgggtaacaaacataatgctgagtgagaaaacgaaacacaaagggtacagactgtgtgattccatttgtacagagtctaaaaataggcaatgctaattactgaggatggaaatcaggacagtgattatccctgcgggggcagggagtgacaagaagagagaagggaagattctgggtgctgattccgttctccttctagatttggatgccctttcatgaatgtgttccatttgggaaaattcagtgagttttacacttatgaactgtgcattattctgcttgtgtactatatttactaaacagtttacttaaaaatggtctctctcctacgggttcccacaaagactttaaacttacctgatgtatgcccccagccctaggtggacctaacacagatttcctgcaagttgctctggaagaatcatctcattccagccccgtgatgttgctgtgtggctcctgggtttggaagcacaaacacttcacaggagttcctgggttttggtttattcacaaacacagagatatgctctgactgtgttcagacttagggatagtagatggcctgacagcgtcatattgattagtatatatgaaagcagttgcattttacttctattccatggctgaagtctagccatggggtgttcttagatctgggctgggagaggagaggttacttagcaaccattagttgatggcatgtgggtggaggcgttgactctacttatagcagatacaagaaatatcattaagcttcatgaagccagaacagaggaactgaactgaatagtaattatgattaaacaaaagaatgcgtcctagcaagtcccatgttgtcagtttacgccaacattgaggcctctagctcagataatttggacctgctgctgggtagactaacgctctagggtaagttgcagtgactgcaggcaagactccatggacctggcatgctccagaatcaccagcaggaggtgctgctgcaaacactcaccagccaggccagggccctggtccctgtagttgccatggtgatgacccaacaaaatggagtcaacagggagaacttggcagccactctgatcttggtgatgtgcttgaagggctctgccctgccctcttcaaggtcaagcctaaacagtgaggcaaacatattgaagcatttgctctgcttcctcattggtcaagttgtttctctggtcaacagtagtccaggagcttcctccatagaccacgggtgccccatcctgcaacaagaagccaagcatcctccctggaagtgatcaggccccagctgggttcatggaaccttcagctcacaaattgcatctaagctgttcttcccaccagcttggctgaggtttgaaaaccatattccttttattcctttaattctctgtattttgcctcttttaatatttctcttacatatgcatataaatatataattaaatatcctttctaggtataccaaaatggtcagtttaagctggaaaatacatactcagatgcacacacacacacccattttccactggtcaagtggcttttgtcatgtcattgagtttgaagaaaccttaccaagcttttagcctgatcttcaacccatgacagaaattcctttttcagcatccctggagccttctcagcctctctttccttgaacaccccaggggtgagtacagtatcacttagtaagtttcgggttgcaaatggcaacaaaaagtcaaactgaacaaaacattaaagggaatgtattggctgctgaaattgagttggaggaagctcaggcaggctccacagccttggggtcaattttttctggtggtcttgctttgtcctcaactctgaagcctctattcccactggccttcctcatggtcacataatggctgtcactgccccagattgttgtctgcactccccattctccaggtgggaaaaagtttattttttggtcaatttttattgtattttatttatttatttattatttttagagatggaggcttactctgtcacccaggctggagtgcagtggcacaatcatagctcactgcagcctcaaactcctgggctcaagcaatcctcccacctcagcttcccaagaagttgggactacagatgtatgccactgtgactggctaacttttaaatgtttatttatttatttttgtttagggatggggtctcactatgtggcccaggctggtctcaaactcctggcctcaagcaatcctctcaccttggccctccaaagtgctgggattacaggtatgagccactgtgcctggtcagaggaggtttctattccaaaaactccatgcatgcattcaaagtcctatccactctaaatgattgactgtgggtcacatgcccagctctgaaccaattccagtggtcaaggggaataccacatgctcactggcctagccctgggtcacgtgatcaccctgaatcaatcacagtggttagacgaatgtgatccttttgtggacccatcttaagattgctaaatgttttcatgatgaagtatttcttttatctcagccacttttgatgatccagactgagaaactaattgactcttcctccagttcatcttcccacactcctgagttcaccaaacacccttaagtcctagaggtgggggctgcaggactcacagaggaaatggatgcagagagctggcctccaggcccttcatggtaatagaggagtaaaaatgcacacatgtgtgtgaccacatagacaaacacaccccagtacatgcaaacaccccagcacacctgcccacatctcaatacacatgcccacatgcacacacatgcacacatacgtgggcatacacaaataccccagtatacatgcatacatccaagtacacctgcccatgtgcacacaccccccaacataccctcccatgtgcacacataccccaacacacctgcccatgggcacacacaccctaacacacctgcccatgtgcacacacaccccaacacacctgcccatgtgcatacatacaccccagtacacccataccctggcatataccccagtccataattgcccatgtacacacacactccagcacatctgtccatgtgcatatacatatcggcacatgtacacttatgcacacaccatggcacacacaccaccagaacatatgcgtatgtgtacacacaccccatcacacatgcaaagattgttgtaaagcctattttggagaatgcgctcaggataaaagctacttttcagcttcctttcctctctgcccccaagatatatttcccgacacttctgggtcacagccttcagagggatatagttaatacccaagggtctcaccactgatgagctctaaagaattacttagaagcatgattgtgtgccaataaagaggataactatcctattctctgagggctgcaggcagtcttcctccttgtcccatgacacacttgtagttaacagatagaattgccaattgtcagaaaataggcagcccctctgagatcagctctatgcactttgccaggatttgctttattcattaaagtgagtttttctctcatggggtgtcacatccaggttggcttctcagcctgctgctcttcagctgactccctgaaacaaatttcctaaaactgactctgttgagtcccaatccagaactttccctcatttctaaatgatataaatttccttaggaaatgtttaaattggctaccagtattatggttttatggcatccacattacacatttcacagatttccaaacctgcatgtatcagaactgaaaagacctgagcttaaaatcaaaagagctgaatcactgtgctctctgaagcttagagaaccatttaattggagcaatcaatgtgcaataataaaagcacttttgcagtcgttttacttttttcacttgtaaggacaatggaaactgttcaattgaaaagtgactaattgatcagttatatggtcattcagcaagaattttttgaatgacttctctgtgcaaaacactgttaggtgtgatgaagtgtaaaaagaagtgtaatacaattcaattaaatgaggcaaataatgatgagttcctgccatgcatcaagaagtctgctagattctgagatgaggtagtgagcaaaatgcagatcttatcactgaagagatgacagagtcaagtggtgcatccactaaatcagtaactctcgtttagtaaatgctttgtgctaaagaggaaatgagttaacattggacacaggcaaagtctggggcatgccttcatttcctacaagttacatgctgcatggagaatgtgggtgggtgctcagagagatggtgggctgtggtgatctgtgaaaattataactgtgggcactggctctggactcaggcccctcaggacaaagccgtctctacccttactcactctggatgtgcataggacattgaaatgctccatgcctcagtttcccaagctctaaaaactggacactagtacctaattcattgtgaatgagacagtgcatgtagagagctcttgtgagccattcctggagctcagagggtgggagggggtggctgtcactattggagagtcacagcaagttttggttcctactgggtccaaggagaacgctgacaggcaatgtagccagaaagagtgtctacagcatgataaaagaaaagcttcttacaaattaacagagtttatttgagcaaagaactattcatgagttgggcagcactcagaaccagaagaggttcagagactgccacccagtagtctggacagtgagcttctataggttaaacatgaaagcagataaatcacctgattggctaccactaggcatctgccttatttaggcatggtgtgatgagtgggctgccaatgattggttgaaacttagctgtttctgattgcctgaaatctggctatttgttacaaaaaaaaaatactcctaagttaggtttctgtttgtttacttaccaagttaggttgtaatttgttacttaggagcttaaagtagggggatagccttaggctaacggccttctgcttatttaatttatcaagtacataaagatcatcctgcctcaggaatatggcattgcatccagacctggtaccaagctgtgagcctcccagtctggcagaggctttaaagccatcaagcccaaagcatgtggtctgccatgctcctttgccctgagccatccctccacagtgtgggaggcaacttaatgtagggttgtgggttgtagcaaaactggcttctctctggctggctacagtctgtgaaggcactaagcagcagcgagaagttaagtaaacatcacaatgtcattaaattgctatggcagtaaatcttagggtctcaggttcagaaaatgggtggctctcaacctgggcaatttttccctccaggtacacttgccaacagctggacacagttttggttgtcacaactgggtaagggcataactggcatttacagagtagtggccagaaatgctgctgagcatcctacaatatgcagggcagtcccacaacagagatttcccagctgcaaatgtcaatagttctgaggttcagaaaccttgagacagggcagcagcaatggctggtgcttgctgggggaggagggtggtttaatctgagtcttgaaggaccaagaaagttagaagagcaaacaggagagtgaagtattccaggaagggtcccagcacaagcaaggatgggagagaaggatgtttgaggggcgataaacaggctggctcggctggaggggtgtttgtgcaggcgatgtgtggagggcgtgtggggtttgctctccaggcctgagcaaatcctcaggcttcctctgagaaactccccatccctgtccatgtggtcaggagggactttcagtcaaactacaacctcccgcagtccagggggtaacatgtggccaagacaggaccatcccgtcctcctctggggacctgaatcatgaacagtgacaagaggaccctagaggttgcagtggaatcattgccagcacaggggaaccaggagctgccctgatgccccaaccctctgaatttggctcttcacatttaattttcctagagttctgtgacttacctcatatcttgccaataaatgtcttcaaaaaattaaatcaaggaatccagaggtggtttctgttgctttcactcaacattggttgggagtctgtggctcgggccttctcgtgcctggaccctaactctagggacagctggtttcaccaagcagaaaaatagtccactgaatagaggactgtggtgtgctgtgcactgatggcagcaacacacacatacacacacacataaacacacacacatgagagaggacacatagggacagccaggttcgtggccgacactgagcagccactctcctttcttctttttttttttttttttttcttgagacggagtctcactctgtcacccaggctggagtgcagtggcacgatctcggctcattgcaagctccacctcccgggttcatgccattctcctgcctcagcctcccgagtagctgggactacagacacctgccaccatgcccggctaattttttgtatttttagtagagatggggtttcaccatgttagccaggatggtctcgatctcctgaccttgtgatccacccgcctcggcctcccgaagtgctgggattacaggcatgagccaccacgcctggccaccactctccttttttccttggtaacagagccctacttttgttcacccctccagtagaaaacaatgtgctgaggaaaggtggccctgcctcagccctaagggacaaacatgattgctcaatggttcaaggccaatcaaagcatagtaatcctcttcccctttgtgattgttttgcaagcaggcctgtcatccagttctagccaaagggacttaagggacatctactagaggcttctgggaaagaattcccaagccacacaggagaaaaatcccccagctctccttcccaacctctgttttggacaaaggctggtgatgcttgagccatggcagccactggaaacctcaaggcaaaggccagagaatctcagagatgcagagacagaggcctgacattctagagctagagagtaaaccaaattagagttgtcttttctgggcttcttgttaagtgagttaataaatatcttcttaacttaagatggtgcttctgaaacttcaatgtggacatgaatcacctggggctcttatgcaaaatgcagattcttattctgtagatctaaggtaaaatataagattctgaatttctaacaaactcttgatgctgatgttgctggtccatggaccccactttgagtcattagactataagccacttttagctgcatattctgttacttgctgccaaaagcatcctaactcttttgaccatttgcatagtagccccacccactggatggaacccagagtctcatcttcccatcaatcagattcaccctcctccacctgtgggaggagccgagagacaagtgcttggggagaagaccatcctccttccaaaaggcaagagcacttcctggtgttgtgagcctgggtgagagagagatggaggaggatggaggtagagccagatcgcagggacagatgctgatttggggatgttctgggtcttcgattgcctctttatggtctgtttatgaaacccagacgccctttcagtgagaagcaattctgccatgtttattttgggaaagaagccacaaaacccaaattgtcatctatttcccagtcttttccagtttccaggcatatcatccttttctatgccttggagaacatttcaagcctcctggaatttttcaccaaggagggacctcagggtcactgcaacaggatggcctgctgaaccaccaagaggcctaggattctatcctgaaaatcagggattccatgtgggtctctcaggcccagctctcttgtgaaattgagagcttcagattagtcatattcggacgttgagaggtggagggaacactggaaatggctctgccgctcatgtgctgtgtgtccttgggcaagtgatttggcctctctgaaaaccagtttcctcccctgtgaatggcagaagttgggtcaggtgatttcttagggccttgcctgctctaagcatttcatggtctcaacattctcataaacaggacttagcttaggtcagtggtctccatgttggctgcacatttgagtcacctgagggacattatcgactctggtgcttctgtgttctacccagatgatctgatctgatagatttggggtccagcttggccatcaggaatctttaaaccttcccagatgtcactaacatataaccaggattgaaagccactgggctacgcctgattttatagaagaggaaactgggctcacatctctggtcagcaggtcagccaccagcagaatccagtgactcccgcttgcaggtgtgggacctcacagccaccctctgcagtgcagcgcatctctaggacctggggaacattgcacctttccattcttcaataaacttctcctccatctctttccctctctgccccgcccctcgctccaatgagctaaatctctctcaagtagctcctgcctctgtcctgtgaacgtgcctgccaggaggagtcgccatgcctggttacctccttgaactagggaggaaggagggaaatatgggcttagacacgtggaactcagggtctcccatgtcactctgactaccacccaaagcaccttgctctgggtttgtcacaggacaaggggaagctgctgtgatgtcactgagggtaatgagaaagttgaagaagaaagaggagagaaatagcacatctgtaattagacattcttcctggttgcttctttgcatgttgaaaatggcttgctacaatccagtcatgtttagccccttggggtccctggtgcagtgagtccaggaccaggactgggggctttactcacagctgccttcccaagtcctgttgacctttgagcatctcctgccccagggcccaagagagcgctgcagcagccacacacaacatgagatgcttctctgggtgtgcctggcttcacccttctgtgcttctgatggcagaagatagaaagtgtctcttccttccttgcaagcatttccatctcggaagactctctggggaaagaacacgaagggggagaggcttcctaagtcccttcactgggggcttatccgtgaccgacgttcctggggagacatacatttcatcagtcactttccatctcactccactctccctcctcctctctgcaagcttacactgcagcccgatggaattacacacagtgccctgcatatgccaaggttcttccacctctagtcatgctgcttcctgtcctgacacccccttcccaactcgatcctgctgagcagcctgggatctgtgtacgggacgcccctcagagtcacccagacacaggggaagctggggtgtttattccccgcccctcagtcacaggtgcaggcctgctcctggggcactcaccccagcatctccaacgctaaggcagctcagagagccactttcctgtccaaggaacccttagagaccattcccaggaggagcgaatgtccacctgtgtggcgtcctcctggggcgctccttctaggggggaccccagtccctcctgcccttccacccagaatcctcctgtctcctgggtgaaaactggagcccagattctagctctgctgtgtctctcagactctggtgagtgtcagaatgttttggaggccttgttaaaactccgatggccaggcccaccctgaggttctgattcaggaggtctcagcagagcccagagctggctttcccagcagggccccggggtgctgatgctgctgcccctaggaccacccctgagagccctggctctccaccagagcctgctcacctggagacagtgaccacaggccacaggtcacccctcactgcttcactccacgccctctcctgtgacctcatctcctcccacctccccctgggtcacgtggctccagccacacccacctccctgctgttcctcacccaggatcaccaaggtctctcctaccccggggcctgtgcacctgctgtgcctctgcttggggtgctcttcccagggcttgcccacctcctcagagaggcctcctgacccctgacacggccttgcccttcacctctatcgtcctttagaacagcccccacctcccgcacatcatgcagttgcaggttcaatggctactgcttgtcctccagactcgtgagtaactcgtgaggtggggcggggcgggggcgggggcgggggcgggaggggtgggggtgttttgttccctgctctgtcccggcactcagagcagtgcctggcaggggtgggtactcagtacacacctgttagcaagtgactccgatgcagggaccgttctctctaatctccaagtccacctttcttatactaaggattttcagtgttttttcatgcaccatccaatcttttttgactcttagatcatatgcctcagagcccatctgggtacaaaaacacccgttttcaaaaaaggaaccagaaagtggtttcatctcgctttaggatgtgaatgaaagcctctccttccgtctcccgagaagggactttcagaagctgcaggtgcccaggtccaggccccacgctgtggccccgcagggactgtactcactctttatttttctcttttccagctctccacaagccaacagctctctcctggctttgattttcaaccatttaagttgaaaaaaattcaaaacaaatgaaatgcacttaagagaaagccttgaggagttcagcaggccacccaaagtgaagggactcctttgggggtctttgttgttatcaattatttattgagccctgatgtgttcctggcgccaccaagaccgaaaggagacagggtccctgccctggggcatcccaacaaagaagggagagtttgtgaagcttaaaaatgtcccagatggtaaaacagttacacgtcatacctcaaggctgctctatacttttattatagttttattcttaaggctgtttatttattttctgatgtaaaaggtaatagaaagtttataaactattcctagaatatagacaaaaaataaaattcgacttcgtccagcatttttaatgcacatgtaagaactctacttggtttatggccgggcgcggtggctcacgcctgtaatcccagcactttgggaggctgaggcggacggatcatgaggtcaggagatcgagaccatcctggctaacatggtgaaaccccatctcttgctaaaaatacaaaaaattagccgggtgtggtaagcaggcgcctgtagtcccagctactcgggaggctgaggcaggagaatggcgtgaacccgggagacggagcttgcagtgagctgagatcgcaccactgcactccagcctgggcaacagagtgagactccgtctcaaaaaaaaataaaaataaaaataaaaataaataaaataaaataaaaaactctacttggtttatgaaactgggatttagtttgaacgtgtactcttcagaatctgccttgagttgacatcaaattacatcacctacatttattcatttttcttttctttcttttttttttttcagagtttcgctcttattgctcaggctggagtgcaatggcgcgatctcggctcactgcagcctccacctccaaggttcaagcaattcccgtctcagcctccctgagtagctgggattataggcgcccggctaattttttgtatttctggtagagacggaatttcgccatgttggtcaggctggttgcttacatttctttatgtcataaagcaggcttcaaaacagaaattttaatctcttcagaatattccatcacatagatatatgataattgccttcagtagtcctctattgctggatgccagttttttttgttttgttttgttttgtttggttattataaataacactgccatgaacttccttagtttcgaaagatttgaatcactctcattataatttcagtttatttgttaatttaatgtattttttgagacaaggtctcactctgttactcaggctacattacagtggcgcaatcgtagttcactgcagcctcaaaatcctgggctcaagcgatcctcccacctcagcctcctgagtaactggaactaaaggcgcaccccgccacaccccactagtttttaaaatttttttgtagagacagggtctcactttgttgccctaatttcactttataaacaggaagaaagaaaacctaactttaagtttgaaaccaaatcctaatgctttctcgcagttctatttgctgaggttaaggtgggtatgaaggatgttgttgaacccactaggctgcagttgcaccgaggaactgcgggtctccaccaggagtgagcgcgggctcccagtgaccccaccagcacctcctgtttttttgttgttgttgttttttgtttttttgaggcggagtctccctctgtcgcccaggctggagtgcagtggcgcgatctcggctcactgcaagctccgcctcccaggttcatgccattctcctgcctcagcctcccaagtagctgggactacaggtgcccaccacgacaccagctaatttttttgtatttttagttgaaacagcgtttcaccgtgttagccaggatggcctcaatctcttgaccttgtgatctgcccatctcagcctcccaaagtgctgggattacaggcgtgagccaccgtgcccggccactccagcacctcctctttcaagtacaaatccagaccaaggcacagggcccctgctgggtctgaccttttagcacaaagagccaccgaaccatgggaaacactaaataatttgatgcaaagtaatttctttcttaaacatagggcatccctacagctttctgtcttattttttagctccatatgaaagagtctgctctggggcaagtccacgaggccctgagtaccactgggaatggaagctccactgaggcacacataagcctctggtgcttccgtctctgccatgagagggtggaagagacactgggccacttcaaagttgttaggtggccagttgctgggtgggcattatgtgagggacacttcactttcccatttctttgtaccagacagaaaaacagtggaaaatcagttatctccagtttaaagttgatgggtcaactaaggctctttgggcttaagaaatcagttcatataggtttttgtttgtttgtttgtttgtttgtttgttttttgaggtagggtttcacacggtcacccaggctggagtccagtggcacgatctcagcccactgcaacctccacctccagggttcaagagatcctcctgcctcagcctcctgagtagctgggactacaggcgtgtgccaccacatctggctaatttttgcatttttgggagagatgaggtttcgccatgttgctcaagctggtgttgaattcctggctcaagtgatctgcccgcctcggcctcccaaagtgctaggattacagatgtgagccaccctgccaggcccagtccatatagttttaagctcatttggatttaatataaaagtttaagcttttggcctactgtttaatattgaattgttcctttcatggaatcatgaatgatttttcacaagtttctcttctttttataaaaagtgactctggtggccaggtgcagtggctaacacctgtaatcccagcactttgggaggcaagccgggcagatcacgaggtcaggagatggagaccatcctggccaacatggtgaaaacccatctctactaaagatacaagttagctgggcgtggtggcacgtgcctgtaatcccagctgctcaggaggctgaggcaggagaatcacttgaacccaggaggcagaggttgcagtgagcctagattgcgctgctgcactccagcctggtgacagagtgagactctgtctcaaaaaaaaaaaaatgactctggctctggctctatatctaaggggtcaactgcaccattgtcaccacaatgccattttctggaaggaaaagctctatctgacttcacagtccttaggagccttgttatggaacctggtggacaaaccattttaactggacatgatgttgctttttaatcaatgactcctgaaattttaggtgagtatgagtctggagttttagattacaaacaacaggaagccaattcaacccagctttttaaaagaagatttctaattaaatgtgttgattctgttagcagagaactctgggggcagtgtgggttgcaggcatgggtagatccaggtgtcaaatgacattctcaggacccatgctctctccatcattggctctgattgctcaggtttgggctccattcttgggccactctcttgctctgcagcaagatggtcaatggcagctctaggctctcaccctcatcttcacatctctaagtccagaacaaagagctttccacacctgctacagatctgggagaagatgatcctatctttcttgaacctgaggctagtccttactcctccctaagttctaacatatttacttaaaacaaggcactaatgaaatgactatataagtgccccactgcctcagtaggcaaaaaatgtgtttttatatatagcttattctaacagtattcaaactgtggcttgatcttactgagctccagtggccatagagaatatgattctttcagatgttttcacaacaacttttacagcaactatctttacacctgccttccctttctcctcatcagatcaattagtctggtttcttctatttcctgcttactttccgttcccccattactgaacttctgattgaagaaatatacaggactgggcactgaggcattgaggatgctttcaagttagcagtaaagaaatacccacagggtcatcctgccatcccaacaattgtcttctttctgctaggataggcctcatcactcctcagatgattctcgaaggataacacacaggccagtgggcagccctaggccagggggattaccaagacatgaagactttctttctgtctcagcaaccttcatgcttggtcaagcaaaggtgttgcttaagtcaaacccagggcaggggagagcagttgaagcaaagtgagtctttggaggccctgtggttgtggggtctggtgtggagacagtgagaacggaaaaggtgggagaggagcagtcaacccgtgaatggccccattcagacgcctttacctggaagacgtggcaggtgagcagcaagtgagcgggagagtgggagagagaatgaggaagtgagggagagaatggatgagtgagcacctgcttggatgagccgacacccaccagggatcatgagaacaccgaacagctgaggcacggtggcgtctctcagcagcctccccaggcctgtgcccctgggtcctgacatgagagctgatgaccatttattatcactggtgatgtcaagaggtggcttggaatggttgtaaccgtctgttcattttcatctcacctccacatccaccacaaatacacagtgacgttgctctgcaaaagcagcagcacacagccccccagaagccccttccaggtaattgccaaaagtttcttccatatggaaattctgtagttgtgtgacctcaggctagttacacaacctctctgagctttgccatcgtcttctgtcctatggtaagaatgatactgaggtactagggagctgtgaagcatatgctgtgagacaacacagctgagcagcccagccagagccccctggggaagccgtcagaggtcagcagctcccgtctccttccctcttgactcctaatagtctaggacagaactttgccctcccttcttcctgtcccaaagatgcacaatgataatgatgctgatggttatttagtaagaaacttcccaacaggaacagtcatcaggagggggcacagttggattctctccagtgaagatgtcaggatggacagaaatgtcagcgtaatccaaagaggacacaaacacccctgctattttcttgtcaccaggaaaaggccagctctaggtttgatgaatgtttagtgaaagaaagtttgcaaaagtagaaaagaaactgacataatggtagccaaacaggctttctctgcattagaagagctaaatatacccttgcatgtctgattagagaaaaacaaaacaaacaagcaaaagctcctccgatgcacagaggtactgctccattgaactagaccagaagagcttgggcctgccccttgggaacaggggtcaacatgatgcggtgggcagggacccatcatctgacaagaagatgccctgagggcaatggaaagcacggtgtgtcgggagaagatggccctgagggcaggtgcattcaggtgcttgtgaacgctgcagcatgttgggtctctagttttgtatcagtcagctactctcacaacaatgctgtgtaacaaaccaccccaaactcagttgcaaacaatgatatttatttctcattctcatgtccacaggtctactggggttcatcccatctgagccaggcctggcttttcttggctgcaagctgagagctgggtccaggtctgctgaaccaaggttctcccatcttccttgagccagtgacaatcagaggcctatttctttcatgacggaaggcaggagaacaagcaggcaagaccagctgtgctagcacatggcacccctttcccacatcacacctgctaacatcccattgttcaaagcaagtaacacaaccaaacccaatatcaacaggacaagaaaacagactccacctctaggtgcacaaactacagagtcacggacagagaacacagatctagggaaggaagctggagaatgagaacaatgaccctcaataacacaacctcccacaggtttccaaatccccaacctgagcatatttccaaggaaacggaatcatgggttcagggttttagagcaagcaatttctgctctcccagcttagtttccatacccttaacacaggggcaatgacgtcgcatcgaatcatatcttataagtctgtgatgatgtttcaacaactgaacgccagaaaagtgcttagagcaaggccaggtaggagggacagaagccaataataatgagtagcatcactgttaacccgcaaaattctgggaatttcctcgaaagtctaattagagaatcatgtccccaacaattaacagttattttgttttttttttctttgaatctgagaaaatactaattgtcacagggtagaatatttatctgatgagcgtatagaagttaagggctctttggagtcacggtgctgggtttgggtctcattcctcctcctacctgcctttctgagccttggttcctcatgtgtagaaggggtacaatcccaacctcatgtgtttgtggcagtcggggttaaatgggctaatgattctgaagtgctccgcgcaggcctggcaggtgctgagcaacctcaggccatagagagagcactgattttggagtcaggagctgggacctcaggtcctattccctggggatccgggaaaagtcccttggcttccctgagcttcatctgccccacgtgctagtgaggtggctggaccagtcaggctaaggacgtccctgcagctatctaacttccccttactccctgttcagcaaagggcaggagctgggcctggccaggctcccacaaagcccaggcgtggccgtgctcagctcacggacgggtgtgggggatgcgtttctgccctcaaaggactgagctccagtttctttcttcactgagtcctttactctctgcctgcgggtggttatttaagacatctcccgcctgcaggggcctcttagagaacaaacagatcgttccttcagctgcagtgcaggctttactgggcttgttcctgcatcaagtagacagatccttcctgaatagagtcgccccacaggccccacacccagagaggggcagccaggagcctccgaggcgggctctgcccagctctgccttgagctctgcctgactgcagagaaggaaagttctcttcttgcaacctcaaatcttccagataagaaccaaacgacatccggcctttgcgttctctccaccagctcccggctcacccacccagcagctcagcacctgcgaaatccgtctcccgatgcacacttgctaaccgcgtgggtgtgagcacaacgatgggaaacagcggaagtccccggagtgcagactcaggagtgaacctgcctgaagagtggcgtctaacgcacacactgtggtcagctccaccccactatgggtcccgggaataggagcaagtatgtattttgcttgcagggcaggtgtttcatccacattattgcaggaacagatgaatttaattaaaagaacaccacagtgggcacctcttccagggatgtctccctctaagaacatgacactgagatgatcaaggttctaaaagggcgatcaaattactctccgaaaatgaaactgctcagacagaatgacaattaaattaataacaaccaagacaatgcccagatttcatctccgctcacagcccctcctgtgtgctgtatgatcaggttcttggggtggctccagatacagcaaacagtcaggattaatccacaagagtgagctgtcagcatgaggttcccctacagtggagcttgccaaggtccgtgcctcccagggcacccgttccagggctaacagatgaagcatggaaatgctgtgtggagtgagctaagcagccgttctcaggagaaaacagacaaatcctcctgcatcctggcaaaccagctttgtggcctgttttatgtcatctttgctgagctccaccgggtcacccctcctgttggctttgtgatactgacatttcaggcactggcacagatacattggccttcctggctgggatttcacggacggagtgagcagtgctggcttggaggagccgtggcggcacagggcctgtgctctcagctgatcaacgccttgatagccaggaaaggcctgtcctaccccaaagggccctcgcagcactgtttgaaattgctcttgccatctttggaatggattcctcagtacatttcagactcgttgttgtgactttggttttaatccagggacacaccgtggccagtggagtgtctcaacagcatctatgatcgctgtttcccagagacagcatctcagataccgatgctgaaagagaaacagcagcctgtccccaagtggcaggaaatagtccattttaatggcaatttcataagtggcagatgatttttattgtaattttctggtgagctgattaagtggaggcagagtcagttctgaggcgtcaatgtctttaacaattcggggagacggaggccacgctcagcaggaacactgagtccatggaaaacaggccctgggcccgctgatgtgcataattccacgtttgcccctcatgtaaccaggatggtaaattacaggtgtcagataatcacgctctggagtggctacttgaggatgcgatcgaccaatttaagctccgtctgacacatgatcaatagcccgtgatgctgcatggaattgcaggcacagtgtccaaacctgcagagcagtggctcccagctggggcaactttgccccccagaggacatttggcaatgtctggatatgtttgcaattgtcacaactaggaaaggaggtacccataggatacacaggaaagtcctcacacagttgtatcctgcccagactgtccgtagagccagggtgagatgctctgacagagccacagtgaacattgcattccatcatctgggtatctccaggaatgtatgtagctggatgtctggcttttcatctgggtttcacgagcctcctgcagaactgaaaccatgtgcaaatcagttctcatacttgctctcctgcctccttcctattgtaattttttcttcccaccttttttattgttactagagaaatgatgaagaaaaagaataggctggagagtcactcaaaattttgttttcctcaattaaaaagaagtaatttagaagttactcaatgatgttttctttaattaaaaaaaaaagtagtttgggaaagcagaaaattaatgaagacagaaaacacaggtttcatgaaaaagttcagcatcccaggaaaggagcaaagagaagtctgcagatgagagttgctcagtgtcaggactcagaaaacaataccccaagataatgttcaaacctgagtgctttgaacaaaggatattgaaagacctcagaagagggcctcagaactcacatgtctctctgaccttctcctgtctctccttcacttccaaagcatgatctttggccaggggatctctctgggattcccttatctgcctgagggatgtacttccaaaagaaatgtgactggcatgacctcctccctaggaatctcttcaaacagccgggaaagactggtcacctgagaggagattggaagtcctcactgcactcagaaaggctgttgtccattcttctagagactttatctgaataacaaggcaacttttgtttaccattcagttcctcccctttcctttctaacttgtcaccacctcccccaaaagcctcaagcctccactcctacaagctataaagacttcaaccatctggcttctccatgagtctcatgttttgtgtggctcttaggcatatgtgcatggtaatacatgtgtatgcctttcctccgggtaatctgtttattgtcagtttaaagcagccacagagttaaagacggaagccttcagaaggctttccctttgcccctgcatccatcacctgagagcccacccatgacagacttgaactatggacagaggctgcagtcaatagagcccagggtgagactgactacaggagaagctgggccttgggggataagcccaagcttctcaattctcaaactgcaggttaagcctctataatggagcctgaattccattcagtgagtcttgaccagcattttaaaatgtgaaataacagaactcagtagaaaatatcaaagggcattacttatagtgaggtaagaatattctgcgaaattttagttttatattgagtgtgtgtgtgtgtgtgtgcacgcgcacgccaggccttgttgtaaaatatacttcttataatgggttgtgttcaaaacagcttgtaaaatatgggagcagatgaaatgatggaggatttggtaagaactaaatatttgtaagcaaattttgcagtgaaaagaacaaggaaattattaattcaagagaaatcaaaagtagtataagaaagaaaatgcaaccatattgccatacttggctctgctgtaaataacatctacttggccacatgacataaatgctgattatgatgatgtcattgaaaacggtaatttagccatgcaggaggctgtgagttatggtggcaagtggaggaagagagctaatccctcctctgggggccggcattgagagatcacagagcaacttgaatccccgtgaagcacttgctcttacaagatttggaagaaacttgcacaaacagtaaagtgtctttacttgtggatgtctctgggaaaagatgggcagggaacagaaagattcaacggtgtttgatttggtgaccatatatctctttaatttaaaaagggatcattcaggaccagtgaggccatggtggtgttcattggaaagagcccagggacccaggtggctcttggctccatcacctagaaccccatgcccttgaacgagtccctctccagcttttgacaccagttggccaacctctaaaacaaagaggccaggccaaattattttgacttgtccttggagccctgtgagtctgtctcaccacggagtgacttgggagtctgggtaccacccaccctgactccatgtcaaataccgtgcacatctcaagcacagtgcctggctcagcacaggcagcaggaaagctgtgtgggtgtgcatcagggttggtggacacagtagacagcctttgctctcccaagatgggggaggtccggtaccatgacttagggaactgctggttcctaaccaacccccccacccaccccggacagtagtgcagaaaggatgctttcctaatcagctaattttcacaaaatgtgggatgccctggtgggatcccgtggtaggagagtagatgacttccaggagcacatagagggggcagaggctgcgggctgacccttgatacccctcatccccttcatttaacattagaaatcccaaagtttagttgcctggaccggaactgaatttcccatcctgccttgcagctggtgtgtaccttcccagtgtacccttaaatgcatgagtacgccccacttacccttttcctcttccctcctgcctgatgtgacttgcacctccttggaccaggtggacaagaaaagcctccgtcaatgacagagcccaagatgggcaggtcgaggatcagccccgggagccgcccaactagctcgcccctcgcccccgccccccagcccccacaatcccccgatggcgaggctgtcatgtgggagaaaagcaaacctctggttcatgaaattgcaggtatttggagcctctgcacaagctagtgaacttgtatatcaataagtagggggagtacattttttatttcaatagttattcactttaatgtgtattagaaaaaaaattccaacttattaatcaaacctgtgatttcattatggcgacagaggacgttaaagtaggtaacacattttttacttttaccatgagtaaaaatgtgagccggtttagtttaaaagaaaacgccagaaaacagcatgggcatgacaagggtttggcaacaatcacgatcatcctggagtgactgaagctcgtccacttgggacaggtgaccatgtgggggactctggagcagcaaagcagtcagggtgaggggtcagaggcaccaaacttcctcttagaaaaacacgagggaaccgacgaacccatgtccagggaatgctgaggacgctcttgactgtagggggaccgagcacaaagcccccgtcgccgcccggcggacccgagctcctggactcagccttgaccgacactgactctgttcccacagcggccgctttgttcgtctcctttgtggacacttagctcagcgcctgtgctgctcggctgtgacctgaccttcgagggtcacctcctgaattcaatcgctgtgacctgtgctgcggaccccgtcaggaagctcctggtctcctccagtccctcccccgcctcattcgcacaaaaggcctcattgttctgcagggtctgattcagacctgccctggtttcagtttcggcaaacacccagcactggctttgggtcaggggtcactctggagtgaacggggcgccctgagcaaccccacatcgctgtgtgatcccggctcatccacaggaagccccggcccagggacccaaatgggtcccagaagtggaccagatgcagcgccgacggtgatgtggggacgccggcatctccaacagtgggaaagaggaaactttctacttttcattaagccccgtcctcttctcccccagggttacggggacacaatgtcttcactggccatgttggaacgttctggggtgtgaagggaacgtccccaagagcagtgacttgaccttcgctttggctgagatttgaaattctcttcttaccgatctttaaatctgtacacgcaggagtctgttttatatccagccgtccctgtgacctcgggcgagttccttaccttgtgtttcctcatctgtaaagtgggaataatgaccgcacggcctcgtgtgcttgtcagaacaaaatcagacaatgcacgaagacccgttggcccggaaagctgcagctgggccctgacgatgccacgctgtccatctggggaggggaagttcattgctaattcgactcaaaggagaaaaatgcatgtccccctgagctgaaagaaggaacgaagccaagtccaccaggccaccgggtctccttaggctgaggaaatggacaaggagggcaacatggaaactgcagagagcagcaaagcccttcactactgctgcccgaaccctgcagcggctcctacagccaccacaggtcactgggccagaagcaagttagggaacagccacatcaccattcagggaagccgctcccaggcgctgatccccggaatggtggatttgctaacagcagccacacagacacctcacctcacgccaggctgctgagctcagcggggggcacgattgcccaagcaggggtggggcagggcaaggcagacccagtcacatggtgggaaaagccaaaaaaaacctgcctgatttggtaaaatgccagaactgggcattttaaagttagtttttaaggcgtagccatttgttgggggtttttttgccttgtactctcctgtctccctcctcgccacacaataaactgtctccaaggcagccgccctcccgttgccaggacgtgcgaggcagggaggtcaggagctctgctgtgagggcgccacccggcttccggtttgtgcatgaaaacccggctcagcttttccgttccatgaagactgggcttctccaggctgctcggtaaataatcacggattccactgggaagagaaaacatccccacagccccttctccattgtgcacccaacctccaggtgttttcagtctctcaaagagccccgacgcctgaaatttaacaactaaaaccttatttttcatttcctgagattctcttggtggaatcaggcagcctggcagtgcgcagcacctagggtggctcatgatgaaaaatccagaggggactttgccttcctgcatgtccttttgtcaccagaacccggggaccagcaggacccaaagctccctgcgggatcagctgggtctgggaatcactgtcctgggcccatttggacttttcggatgaggccggtgtttggccagcacctgggctgggcaggtgggaaggacagaggcgctgatggagagagggaggggaaggggattcacagccgtcctgggagccccacgggtgcctttggcctctggctcctctgcctgcccctcaggctggttaaattcccccctgaaagttccccattgggcaagtccagcaagcctgagccaggcctgtgatctcagggtgggtggagctctagaaggcctggccctcgctcctggagtccacgttcaccctcaaggcagtgaacggcaccccactgcgcatctactcactaaccaggcacgggatggtttccatggttcctgtgtcttagaccagctcgctcatggtgacatgggacacgctgagaccccaccatggtgcagagtgacattaatgcattaaattagcagcctctgcaacacaaacacatttgcatgtggagcctgtgacgttctttggtaaaaggaatccttacatgtttgcaaacattacactcgctgaggaagggcctcgggctctgacaaatgataaatgggaaaattagacgcttcaggaaaatgcaaatatcatccttcgtaagtctgtccgttggcaggaaatttaaaaaaaaaaaaaggtttccccaaagcagtgaggcattacttctcctcttttaaatgccaggaagaagggctgtgattcttttaggcacttgcatggatcttgatttctcttccacagtctccccaacgccctggcaatgtgtaggggagaagcctgtgatttcagcagactgtcctctaattcagcgtttctcaagctttatttcataatcaccccctaaggaatctttataggcaattttttcttacttgcccccctatgaattttaatactacataattactgcagaatggtttatgcactgtgtggacatctacatttttacataaagacaaaaatcttttcacctctgggagccagctctggcccccatgggagcagtattctccgctaagaaggcctgctcccattccttcttttgttgattttgggaggaggtgcaggagctgcctggggccttggggcagagcgattcgggagaggggacagagaggacagagtccggagaggggaggggagggatgaggccgaggagcagccaggagccccgtgtggctggggccagggggagttgagggtagaggagtgatgggtgactacagggcaggggccgggggtggggggcggagatggatcatctcaggccttaggggaccctgtgaggacttcagcttttactctgagggaagtgggagccattagagggtttcagcagagacaggacatggtctggtttattttttaatggatgatctgtgtgaggacaggttggggttgtggggtcagagctggagaaggaggccagcggggtctactgcaatggtccaagcaggagatgatggtggcttggaccagagggtagctgtgagggaggtgggaagtggccgtatccttgatctgttttggaggtagagcactggcacggtttgctaagaagggtatcaccccagagctgtcaaaggctcatcaggtaccccctcttttactggtattaacttcttatcctcccaatgaggctatgaggcagttatgcattctcttaatgggagactgagacacagaaaggctaaatacagtcctcagagattacactaccaagagtcagagtcagggtttgaacttgggcagaggctacactcatgaccaccctgctgtgatacttgggttatttgggatataaaagtgtaaactggagtgctggctacctcctggtcagtctctctgcagtagccattgctttacagagtagccgcaagctttctcaaataccgctgccttaatccttggccagcccctgaatctcaccatttcctccaccaagctgcagcccctttcatctgcgacaccagtgctctgggatccctgcctaagaactcggtctgccttacccagctaaacactccaaccaggtccttggagctaagaaaagtcaaaagcctggatcttagcagtgatcatcaaaatagtaacaaatatagtaaaataaattttaaaatttatttgctttcattttctaagcaaactaaactctgataagatacttcttaactaagaaagatataagctgtggcacaaatcactcatccaatttgtcactaatttgtcggttgtctgtcggtttttaaacattggtggtataatgtgttgtttggcacagccgccactagctaagcaatgctcctatctgaaactaatggatgagggagccacagccacctcttccaaccacctcttgattaaatgaatggtcattaggtccctggcaccgaggagtcattacagacaaggacaggtggctatgccaccagcacatcacagccaagtgcaccctggagtcccaccttcccacaagacccccaccgaagagctcaccctccccttggccctgctgacaacaagcagtggcaaccctcaggctccctcccccctcatgcaaatatccaggctctgcagtagcaaaatgcagacaaattctctttctctaccccagttcggtacaacctattgttgttactcatggtagatatgttctataaagtcacgcaaacactgaattggcaaatactaagccattgctccttcagggttaggtccccatgagcctgtggtcacaatattttcatctactgatcaatacataaccttgttttatgtgtgtttctgtttaaaggcactttatttaatagatgttgtttcattaacattgaactcacggccaacagtgctacaacccatgactgagccaagtttatccaacccacgtttctcccacccgagccttcccaccctttggaacaccagacggcactccagcactactcttgggggccattttagaaagcaaaatcaccccaaaaaaaagcacaaaaatgccaaaaaacatggcactaaatataccatgaaaagatgctcgtttagtttaaaagctaaagcaaggcagagcactgccttgttcaacctcagcatgttctgcgcttccagcagctcaaatattctctgctctgcttctgtttgcaaatgaccacaaaaacctgccaagtattgattttgaggttacaaatcaattttagcaagcaggcaaatttacaaatatggaatctgtgaatattgaggatggactgtatttcactaaggtactggtgcatcctagctgtgtttcagtcctaccaaagatacatttttcccaaggtgctgcctataaagctgccagctagcctctagctttgcccccacacctggtggtggtctgtacttcctgtcttcaccttgtcccttcctacttgagacttactggtatctcctccaggtggtcacccctttgatataattcggatgtttgtcccctccaaatcttgtgttgcaatgttattcccaatgttggaggtggggcctgataggagacgtttgggtgatgggggtggatcactcatgaacgtcttggtgccatcctcatcctcatggtaatgagtgagttctcactcactatgttagtccccctgagaactgattgttaaaaagagcctggcgcctcccgcccctccccttctctcttgctcactctctcaccaagtggcttgccagctccccttgccttccaccatgagtgaaagcttctgtggccctcaccaaaagccaagcagatgctggcaccatgcttcttatacagcctacaggaccatgagccaagtaaagctcttttctttataaattattagattggtgcaaaaggaattgtgcttttgacattaaaattaatggcaaagactgcaattacttttgcaccaacctaatacccagttttgggtattcctttatagcaatgcaagtggactaagacacccttctatgatgagcccctctatccccaccactttgtaccccatgtaaggcttagttaagatgcctcttgtcacgctgaccccatgcctctctttcactgtgtccttctcattgtgcggcccctgatggatttcccattggtcccacactggaccgtgggtccaggaaagcaaaatctacgcgtccccagtttcttgcatgcttctgatgctccataaatgactcataaatactgagtgaacaaatgaatgaattcatcctaaacagtttcatctgtatttggaatatctgcaatactacaaatagtcacccattaggagattcatgggtgggtcttgaccaccatttacaaatgaaatagactaaagaaaatgtaaaatatgaaatgcattgtacaaagtaagagtattatctcttgaaatgttagttctatataactatgttctgggtcactaggtgtgatggttaattttgtattaacttgactgagtcattgggtgcccagagatttggttaaacattatttctggatgtgtctgtgaggttgtttctggatgagattagcatttgaatctgtagactgagtaaagtagtctgttctccccaatgtgagtgggcctcgtcaaattcactgaaggcctgaatagagtaaaaggctgagtaagagagaattcttcgtctttgcatgactgtctctgagatgcaacattggccttcttctgtcttcagactcagattcagactggaactcacacgttagctttcctggttctcacacctttggacctgggctagaacttacactgccagctctcctcactctctagctcatcacctgcagatattggatttcttgagctccattatcacatgaaccaattctttatagtaaatatctttctctctctctctctctctcatatatatatatatatatatatatatatatatatatatatatatacacacacacacacacagacacatacataaatggatatgtataaactaatgggataccttattatacataataataggatatatatatatatatacaattggtttgatatttcttgctggaattcagggtgaaaaatgcctgaaagtcctaactaccctggacctataacagctcacatacttgtgaattgaccttccgtgaagatgataaattttaaatgacaaatgacccacactgagcctgtgtatcaaggtttcttagtaaattagacaaaaatgtgtcccttttggatctgccagggaaaggccccttttcattctgaccagtgaccaaattcaccttaatggccattgagtgagcaaatctctggcctggtctcacttcacaaaataagacaatggattgagctcaggaataaacacctacttttatgttttaatgtcccaatgtatatgattctgtatatcagagcctaaaatctttctagtggattttccttcagtggaaacttgtaataaaattatttcatttgtagggggaaaaagggaaaatgaagcacaatttgagatgatttaaaatgtttctccagctctaggaaacctgctttgttcaacatatttccccagataaagatgccgggacgtagagtattttttctgtttttatgggagtcaaggattagagatttgggagaggtaatgaagagtagaagggctatcagctcttctaccttttttgagtgtgcaggggctatgggagactgggccctcaacccagggtgtgcctggggaagaggcagggatttgtggagctgtgctctaagaagagattgacgagcatggaattttacagcctatactgaggaaaatcagtggaagagttgtaccttataagaaagaacttgcacagttgacattgagagcagaatcatttgtacagtctcgcacggctgcattgccgtatcaggttactggatagatgaagttataatgagattagaataaccaagacactaatatcctgctagttcatgaatatttagtagatcctctcaggccaacatcttaccctgtttgcattctatccctgaaagaatcagagggtaacttgtacctaaaagcccattagagaagattttctatagagatgttgcacttagcctggggattttaagttttggtcttcatggtgtcagattttaagaatcaggaaaaggaatggcctaattttgcctttcaggacttacatagaataaaggaaaaaatctggacaacaaaaacagaaagacgccaggccccatctctctgtgactaaagcgtaaatatttaagctttgctgctctctaactcgggaatcttggactggggaataggccattatctgggttacactttaaaaggctttcctttcttccatccattctggggtccttaatcacagctcaggtctcccttgaggttaccctgtgcactggtctcaaaagttcattcccaaagtgctgacctctcaggggagacccttcactgtcagggtgggctttcaaagggaggcatcagtgcttgccctgagacgtgaggcctactgtgccctgggcctgacggtgtgatggcctgaacattgctggcctccagccaggtcttttctgagacgcctgtgctcttgccaaacagttgttaaaagtcttgaatctcaattcccactttcagggtctccaaggtcttatacattttaactccaaagtatttactgagccctactccatccaagacacagctgcaggtcccaaaaatacactgggcagcaaaacagacccagcctcacccgtcatggagttcagagtccagtagaagagacgtaccaaataatcgcaaaaacaaagagattatttcaaccatcgtgagtgttgggaaggaaagagacagagagttatgggaacctagaatgggaggagacagacctacacaggaggtcagggtcagcttgcctgaggagggagatctgatgggcgcctataagttaactaggcaaagacaaagatcacagaggtgtggaagggtgaagagggagcttccagcagtggaaactgcgtttgcgaaggccccatggcaggagcgggcaagacagggtggatgtcagggactgaagggagcctgtctgggtggagaagagacggtaaggctgagaatggtgagggtgaggccagaccacccaggccttgctgtccatgttaaatattcacctttcacagaatggtaagggaaagccattaagtatgttaagcagaggtcagaaagtaggtgagggtgggagggggaagagcagggaggctggaggtttactcagcaaatacttcttgagcatctaggatgaggcaggggtcagaagtgagccaaaagcttccctttgcagaggtcatgttgtagtggaaggaggtgcacatttatcaaccagatgcctaagtgtagtgaggacgtgacagggtgctatgcaggaaaataaagcaggaagaaagttaagagtgaatgcaaccggggtgcatgctgagggtccagagaagacctcgctgagaaggtgacctttgagtagagacttaggtgagccttgcatatgtctggtggaagggcactccaggaaccgggaatagcaaaggcaaagggccctgagtcaggagcacgtctgccagatgccaggaacagcaggcaggccagtgcaaatggagctcaagagcaaagggaaaggaatagcaggtgggatcagggaggtgacagggaacctgggcatgagaatgttggtctgttgaaagggcttggggttttattctgaaataggagccacaagagggtcctgaggagggataaggtctgccgcaggttctaagtggattccactggctgcagatggagaaaggactgtggatgggaggcatgggctggggcagggagaccagcagggaggccaggtggaggtgatagtggcctgagccaggtggtcagagtgatgggggtgaggggctctgatgctgcccatcttgcaggtagagctggcaggatttgctggcagatgagaagtggagtggggaagaaagagaggagtagaggatgactcccaggtgatggcctgagagctgggagagtggggctgccatttagagatggggaagactgaggaaggactgtgctcagataaagcccctctgccaactgcaagagacacagggcagcagggacagagtgacggagttaggagatgtgtcacagtcctccaaggaagaacatgtctctctggaatttgttggtctgatgatctgctttttgctgaaatgaccaggctaatggtgttttcgggacctgctgttaaccatggagctgggtcgtgagctgtatatagtttataaaaataattcaaccttcctgtatcctatgacacattttatatcagagaatcataaaaaatcctttttattgaaaaattttgtttaataaatggggcacatgttatcacttagccaaatcaattatctcctccagacatttgtatctttatgaaaagacagacttcttttgactttaatggcgatgatgtcatctcacctgcagcaatagcgcaattttaggcatttggagaaagaggaaagaagaaaagacaaataacagaagtggtaggattttcacaaagatagtcatacattcactaggaattcagcctagagcctagtcactttgtgaccaagaagtgggtcataacactaatttgatgagtttgaaccaacactttaaacaattagagagcataaatggattggaaactatcagggcgcattacatagagtaaggccatgtgttatcttgtacaaatttcattttgatttgtgtaggcatttgtgtgtgtgtgtgcgtgtgcacatgcgcgcgtgcgctggtgcatgtatgcatactggggtcaatgtaaaatgtatttcttttattgtaggtcattcttcaaaatgtttgaaagtcaccagactagaaacccttgatagttcatgagaggttcttctacaatgggctgtgcccttctccgttagagagagggttagctttaccaagtaatagtgctggctttttctgtgctaaagaaaaggcattgagctgatttattccattccagaaagttcccataatctaagaggcaagcaggcaaaactaacggcaaatttctccaaagtggtgcctttttcagtagtgattttcaaagcaagatgttggcatgacagttgctgagactatcatgaaaaatgttagcagaggcagtgaaaaatgtaggacccatcatgagacaccgagagaaggccctaacagactacatcctttaggtaggttcagcccttccgtaatctacaaggccctggccccacctccagccaggtcacaccctagcttggccaccccgccccttccgcccccacccttccccggcctgaccccgcccacagcttggctcctcccccatggcccagcctcctagactgaccccgcctcctcgctggccacacccctaaccggtcccacccctagcctggcaaacacatttttagctaaagtagaccctgccagttttccaaagggctcagagggcacttcagtctcctctttctgtacagatgaaacctggtaggaatgcttgcatttccgccccagccgcctcctttcctgacgccccggaggcctcctcgtagtgtatttgggacaggcagactccgcatcactcagtagatacctaccgagatctactctgtgctcaagatccaggtcccggccccagcggtgaaggaagcgggcaaagccccctccctctgaggtgacgtctccagggctggtcacagggactccagggccacgagcacgtgggtgaccactccgcggattatcccacctcagtcgtaagctcgtggggcccctcccagctttctgggtggtttctgtccccttgaggcgatttacaacccaagtccagagagcgagaggttgatggggggcctggcccgcccctatctcagggaggcaggaactgcttagagctccgtgcgcgtgggacccatggctctgacaaagtcttggacaaacactgcttcccgatccttctcacccggtcgcctcctgcctacagcatctgcggacgctcagccccaagagatgcgagctgctcggggaccgccctgagtttctgagagtcctggggcgatggcacctgggtcctgtgcagatggcactggggagtctcgaaggcttcgactcgggctgagcgtgggggtgggcgcgggggatgctcagtcctgaccccaccaccgcggcccggaggacataagacgggggctgtgtcccctcagaaagagacagcaggtcccgctgtgtgcccacgctgggaagagacggtccagcctccaccaagtggaaacctgagcccagaggaatggccctgccccttccgctcgacctggccagtcctgtctgtgggtttccattgtcagccatgaaggggaattgagactcacaggtggggttaagccgagtgacgggaaggttaattctggatgcacagggaatctgaagatggaattgtgaaacattcatggatttgccccagtattccagccaaccatgcctgtgtgggtgtgtgtggggtgtgtgtgtgggggggtatgtgtgatgtgtgtgtgtgtgtgtgtgtggtgtgtgtggcatgtgggtgtgtgtggtgtggcgtgtgggggggtatgtgtgatgtatgtgtgtgtgtggtgtgtgtgtgggggagtatgtgtgacgtatgtgtgtggtgtgtgtggggggtatgtgtgatgtatgtgtgtggtgtgtgtgtggcatgtgggtgtgtgtgtggcgtgtgggtgtgtgtgtgtggaggggtatgtgtgattgtgtgtggtgtatgagtgtgtggcttgtgggtgtgagtgtgtggcatgtgggggtgtgtgtggtgtgtgtgtggtgtgggaggaagtgtgtgatgtgtggatgtgtgtggtgtgtggcggggagtgtgtggtgtgtgtgtgtgtgtgtggcgggggggtgtgtgttggggttgactgtgtatagttccctgattaatgattcctgcctcctagcctgattcaacggatggagccaaatggcctagtggttaagaacatggtctctggagccaaactgccccactaagcaggtgccttgagcactctgcctcagcttccccatctgtagcatggggagcttagtaatagtgctgtgtctcattgggttggtgtgaggactaagtgagatcatagatacagggcatggggaatagtgcccggcgtgtgccagctcccaccactctgcaaagaggacacgtcctacctccccatagccaactcacacccagcagctcctgcatggacgtggtgctattctctggggacctgcatgcacctgacttcagcctggccttcaggggtcattctccgggtgaacacaacctggttcatatgtaaaggaattttagccctaagaaggtgtctgctaggtccccactgatgagcaccccagacggagtgatctcaggtcaaacgtccctttcagaagagaatgtggcaggaacaagaaagatttcaaatgcttatgccctggacccagcacctccccctctccagctgtgccctggaggatcctccacccacgtccatgaggagacgtggacctgcagggctgtttgtaatggcagaaaattggaacccaccagaacgcccatcaacacagaggggccaaagccaaccctggtggagcctccccaaggaacactgggcacagtgaggaatgaggcagaacctcatgcacagccatcgacggggtctgggctgcccggtgtgaaaaggcaaaatgcaggaggatgcaaacaatgtctacattcacccacataaacacacacacatatggacctagacataaattcacccatataaacacacacacggacatagacataaattcacccatataaacacacacacatatggacacagacatacatgtatttcaaaacccctcaagagcattctatataatacatgagatggactggaacacttatataaatacatcaactgcccgaaagcctctagagtccactccaagcccaggctgcacagacctggccctgcccagctgttctctgatccccacttctcctgtcctccctgccctgctcctgccattccccaagtgccacccaccagccaccatgccctggaaatgcagcatgttcccgctttaggctgctgctcctgctgtcccctctgggggaccagtcctcctccaggtgacccatgacaacctccttctgctcagatgccacctcctgccagaggcctcccctgaccaccaccaccagtccccacccaggttccttccatttcttactctgctctgtattttacttatcatctgcctcattctcggcagaatgtacactccttggaggtgatggagtggcacacagtaggtacttaataagcatttgttgaattaatttctatatcttatctgagtaaccacatagacgactgcataggaaaagcctctgagaggactcatgcccaacccagcagtgatgatctgtgggcaggctggtagcctgggggagatcaatggagacctgagcttgtctttaatgtcttggttttcttacagggaaatacacttatgtattaattgtgtcatgaaaattaattttaatttaaaaatcaatttcatgcaatatcgatttcacaataaagaaatagatttttttagtttccttgatggagatatttgacaccaggcacttcgtcattcagaaagaaccagcttcacagtaaacaaattttggtgccttaataacaagatcagcaacagctacaatgcctgctcctcctgctaacagttacgcagggctttgctcataccaaagctttgcctctcacgacctctttcggtcctcaggacaatgaggcaaagttggaagaagattatgactgtttctcttttgctgaaggaggtggagtgactttctccctgcaatgggttcctattgaaggattacagcaacaattcaccaggctcttcttcacctgaccctgaatctcacagcccagtagcccgtagccctgaccctgcccccagccccagcagtgggctgtgactggcctgatgcagtcaggtcagctcttcccactctctgaccttgactgattcaagaatgggcacctggcccaagggggccagtgaaaggtaagatgttgcctgggctccctggcttttccatggtttgctctgggtaagttggacgggatgcagctcttagaaccactgcagccttctctgctgccatgagagaagacagtctgaaagcatgacccatgagagaggaaggaaccaagagaacttgagggaaactgagccacagcctgatccaatcattcctgatggtgtttatctctgggatttttgaaggcttgagcccacaaatttccctgttggtcacacctgttcccactaaattttctgttccctgcagccatagctctctatctgattctgactctcgtgtcgcatgatagtaaggggtagattattaaactaaggccttccctggctggctctttgtgtgtaatacacaccttctcacagccaacctggttctttacatctaaacttcagagtcagacgagagaccctagaggtcatctagtgcagccccttagtgtaacccctgagcaaagtgaggcctgggaagaagtcgtgagcctggatcacagggctggactttctatccccgattgctcctgtttttaggttaacatgatctaagagaccacctgtgacaagacaacctgagcttcatgtgtcaatgcaaactctgtatctgcacacccaaaatgaagcaaagtctgtatctgcaaacccaaaatgaagcaaagtctgtatctgcacgcccaaaatgaagcaaagtctgtatctgcacgcccgaaatgaagcaaagtctgtatctgcacgcccgaaatgaagcaaagtctgtatctgcacgcccaaaatgaagcaaagtctgtatctgcatgcccaaaatgaaggaaagtctgtatctgcacgcccaaaatgaagtggcaaacaatggcagttgtagatcaatcagtgataaaacctctctgtcccaagtatctggatataaacgtacttttgcttttctttgaaaaattagatgacagggccttttttgtaattgatactgtttcttgggtatagattttcagtgtcaccttaagtgcatatttctatcaagaaataaaaatacaaaatcttaaaacagagcaaagaagaaatgtgaaataataacatccatttcattctgcccccactccctttggactctctgactatgctgaggtttggttttcattttatttattttaataatttcttctttcctaacttttcctaaaataagaacgcatagactgagatatacattctcctggttttctaaagcatgactatgagagatgtatcctaaattggaacttttttctacatggtcgcatccaagggtgaagaaggcaggagccagacatattacagctttgttgagcacagtggcagtgtgcaagtgagaacaggctctcagagtttcacctggtggaaaatgtttatcaaggtaatagcagacccgtcaagactgtgttactcttgcagtgacagatttttatggtaaaaatgactgcaattttaggccactgtaaaatgtctttggtttgtgctgagctacagacagtaagagcttatgtgatagatactcattatctgccatccttccaaggaattttcacattgacttacttcctacaatcccatcagaacagtttaatacaaaagcaatttttatagtctggtgattgggagaagtcatcttgttaatcaatttttacctgataagataatgatgcaaaacacattttaagagaaattttagagaaatcacccatgtggttgtagttacagcagatttgagaatgggagctttggaatcagggatatgggtgttcgaatcctggctctaccatgtacctacccatgtgaccctagggagggtacttacttaaggacatcactcacttgacaatgtcacgtaactgaagaggtcacttacctgagaggtcgcttcccttcgctgaaccaatcctctcatttcaaggattgttgggaaagctcaaagtcaatatatcttaagaccttgcttctcaatgtatagtctgtaaaccagcagcctcttcatcacctagaggcttatcaaaaatgcagagtttgggattccatccaaatcctaccgaatgggaattcgagtttagcaagacccccaggtggtttgtgagcaaattaaagtgtgagaagcactgccttaaagcactttgcatgttgctaggtgaatggcagggactcaacatagtctggctattggtataggttcttattgtgtgtgacagctaattttgggtcaacttgactgagccaggggatgcccagatatctgattaaacattatttctgggtatgtttgtgaggatttttctgagagaaattagcatttgaattagtagactgagcatagaggcagaacctccccactgtgggggagcaacattcaacccactgaggatgactgaatagaacgaaagggcttagaaaggttgaattctggctgggtgcaggggctcatgcttgtaattccaggactttgggagtccaaggcaggaagatcacttgaggccaggactatgagaacagcctgggcaacatagggagaccccatctctacaaaaaataaacttaaaaaacaaatcagcgaagtatggtggtgcacacatacagtctcagctgcttgggaggctgaagtgggaggatcacttgagcccagaaatttgagactacattgagctatgatcacaccactacactccagcctgggcaaaagagcaagaccccatctctaaacaagaaagaaagaaaagggagagaggagggaagtaaaagaaggaaggaaggaaagaaggaaggaaggggaaggagggagggaaggaaggaagagaaggagggggtaggggagaggaggggaaggaggaaggaaggaagtggaaggagggagggaaggaaggaaggaagggaaggagggggcagggaagaggaggggaaggaggaaaggagtgaggggagggagagaaggaaggaaggaaggaaggaagggagggagggactggattatctctgcctctctgcctgactgcttgagctgaaatgagtctctgaccttcagacttgaactgccatctaccaaatcactggctttcctaggtccctagcttgcaaatgagagatcataggacttctcagtctccataactgtgcaagccagtttttaattttatgtatattaatctcctattggttacttctcctttaaaatatttttgtgcagtcttacagttttcatagacgttcacactacacattcaacatggagttatttttaattgtctccataacagtccgctgagcagttatattaccaaaacatcagggtttggactaggtcctgctgctcatcacacagaaagccaagcactgagatgaaaagtattgccaaggaagaaggctttaatcagctggggcccccaaggaggtgggagcttatcctcaaatccatctccctaactgactaaaatcaggtgtttttatagcaggcaagaaatgtaacaatgtgcaagaaaacaggaacttggaaggggcaagaaagcaatcatggtggatgaggggtcctgcagtgatctggtttcagtcctttggaactttttgtgagaggcctaaaggtcatttcctgaggaaagaactcagatgaaacaaacataagtttcaagctttttaagaccagagggccaatgtctatgtgtatcaaaaagaactgtctatggggcaattgggttggtttcagttataccatactttattctcctattccctatcttgattgtttccagaattttgctactagaaaatagcatgtgagtgagcatccttctaaatacagctctccttctgaagggaaaaacaaatgaaagacaaacaagcaaacaacaggaaaaaaaggagagaaaaaggaaaaaaaaatcatgtatccatccctttgggggttgaatgtcttctttaatcaggggtttatacagcagggaataaatgtaaccatgtgtgggaaaacaggaattagggaagaagagttggtcaacaagaggcaggtggtcagcagtcgtgatgggtgagggatctggtgtctctcattgtccagatacagtgatctggtgagtttcagtttcttgatgctatgtgggaggactgatggctgctttcttgagaaaggaactcagataagacaaatgtaactttctcaagttgagactgggagggtcaatttctatgtttactcaaaagaaaccataaacatcagttctatgggacaattgggctggttttcgggacaattaccccaccaagtacaggcgcaaagctgcagggaacacaggatgcaaccggaggagggactggtctcacctccatggctctgatgcctcattatcacctccaagcaggagccctgctaggcctctcccacagccataggaggccctggagagccctggtcttagtgcccctcaccattctctgtccctggtcaccaaggactggccaagaccaagtggactgcaccctctgccacccccacgcaggtgcctgctgccctgagctgcttccctgatgggcagccatggggcttccccctcttcagagccactgcagacaaaagctctcactgcccagagcatgtgttctagaactcaaacaagtaaatgactgagaaactgagtatgtgcaggggtggctgggttgtgggacaaggcaggcagggaggggatggaggatgggaagggcacttgggctcggggagtgggaggggtcaaaggtctcagggagagtgggggatcctcatgcctcagagctggggaagaccgtagtggggatgagggaggacttgggtcctgggcctccttggctgcctggggataaaggggagatgggaacagccggccagttcccagggaagcaatggtagggctgcggctatgagcaaaccagggaactgggtcttgcagcggcgcagagctctggcatctcttccgtcccgtccctgggccaggcctagaggagactggtccgtagcatggtccatggtgttgctgcccctgtggagtttcaggagccccaagggctgcccaggggccaaagcatctcctgtgacctgcccccacccagcaaagggagaacctgggatccccctcttctgaaacagtctttccagaggcagctgcagcttctcatctcacagaggcagcatcactcagaacccccagaaaggccactgattaaatgccacggaggagagtggtgatggggtctgtggacggcagctcagagccagagacaggaccgggtgatggatggccccaggccccgccgctccctgcccagtgcgtattctgggtacaagggtaattaagagaagtgtttcttttttacagccaggtgcctttccctcaggtgctgaggtggttagagattaaaacatcatgaacagaatatggagtcacagagaaagagcagccaatgagcccagcttccaggagggtcacgggaggaggtagagccgcaccgtaggttacacaatggccacccagagacacaagtcctcatccttgcaacctgtacatgcaaccttgcttgtcaaaagggtttgcagatgtcatgaagttaaggactttgacatggaaggattgcgctagatcacccaggtggcccctaaatgctatcgcaagagtccttatgggaaacaggcagagggagatgacacagacgcacagaggaggaaggggcagagactggagcgatgcagtcacaagcccgagaagtgggaggaggtgagggaccgagtcgcctggggagcccctggagggaacacagccctgggattttggacttctggcctccagaactgtgggagaacgaatttctattgttttaaggcaccaactgagtgggaacttgttctagcagccctaggaagctgatgcaagagtggggagaagaagctgcctttattcagcctaactcacggacaaagcgggaacagaaatcccacacatcatttccttgttgctgaggaacggctttgctgcccagagcccttggtgacttacaactcctcgaggtggactgatgggcagagaaggctactgagacagagaaaaaacataaaacaaaacagggatttgtcaaggccctttggtatttaaccacaaaagagatataaacagccaagggcctagattcactttgaaggctcagtaagtgggccttcagctaagacaggcttctgtccatcaatccatccttcatttgctgagcaggtattgtgccaggcacttttctaggtcctagaatacagctctgaccaggacagacctggcccgggccctcagagggtgagtgttctggtaaaggaggcacaataaacaaggaaataaaaaacaagattgaagagggtgaaactgctctacaggaaacaaactgggaattgaaagagcaaagggaagaaaggccacattggatggggaggtgaggacggcctctctgaagaggtgagctttgagctcaagctgagcactgagaagattccagcccagtaacagctatcaggagatcacgccaggtcaaggacacagcaggtgccaaggcctggaggcaggactgggctggacaagtccagggaacagagaggatgccaggactgaggacgtagggagagcaggttgcagggatgcagaaagcggtgcggggtgtggatcaggcagagcctcctgggacagggtaagctcttctggggttcacgggagcagtgggaggtgattggagtttatatggtgggggtgcagcacagctggtgcacatgtctggacagccactgactggctgctgggagggaatggaggattagggcaagagtggaaaccgtgggtccaggctgaatccagacctacaagatgcgagaccttgtgcaaatgcgtctttcctgagcctcaggtcctcgtctgtgaatgagggaatcatgagccatcctgaggctgatctgaggatgtaacaagaaggcgcccaaggcagagcccagcacacagggtcagtgtctttccataacaataatgagtgaaccttgaccttcctagtctcacacctgtgacccaggagataactcaggccaaaataacgcgccctcgggttgccccatgggtgtgcttgtgtagacctggccccttcatcggttcggcgttcattctgtctagactgttagggtttcttcacatactgagaacacggtcctggtatcgggaccgcaggttctaattcacatctcacctgggaatggcagggcagttcattaaagtgactcaacctagagcagagctgttagggaatgaggtggtaaggcttaagagcaaacacttgccttgctagttcagcaagaatccaggaaatcttcttgaagcacatattttcccttgctcagagttttcaaaccccaggctgggtttaatggtgtgggatataatggggtttctctttaaatactctgatcaatcttttatcctttaattcatagtactccctcccccaccttttcttctttttcctttttgcctttgtttgttagatgcccaggcacgcctcagtaccaagcgttatcagtaccagctcacattcctttccttacacggaaaggggactaactttctagctcattacagacacccccttcccctttctctccactttcttttacatacccaccctatctaaaaaaaaaatcaaatgtttagccaaccgggattagtttagattgtacaacccgaccccagccaatggggaaagggtacaggggcaggacttgcctcaggaataaaggctctcgtgccatttgttcagatgtgttctcatggcaactggccaaggaggcactcctctgcgcagaagtaaaattgctttgctaagaatcttttgttcaagtgttcaatttccttaggattttgagcgttgttcctaacaacggaaaccatgatctcttccccaagattgctcagaggtatccacttgtccttccaggtagagggaataaaatgggccaccatgaggcagcaggcagacaaattcagacaaattccaggttggctgaagcattcaaagctaaatccagaattcacgaaccttattccgcaccaaccatctgattgcttcaagattctttgaacagctggctgccagggattctgggtaagtgtagcaccccagaggcaactgctcctgggaattcaacaagcagcgacatgaaaagtaaaatgagggagaagggatcactgtcaaccaaagagacactagagacttaacaaccagatgccatgtggcccttgttgaatcttgattgacaaaaagcaacaggaaaaagacatttgggagacaactggagaaattcgaacatggactgaatgttagacaattatggggaattatttttaattttgttggaggtgataaagatattgcagctatgttagaaaacatccacgtgaggtctggggtttgccttaaaataagttggcaggaagaagggagagagctcgaaggaaggagcaaaccctgataactgtgagcctgtgtgatgggtgtatggtggttcacaatgttcttccggttgagatatccagagtaattctttaattgtattcagtttatttttcaagattgcaatttctttgagaaagtgttgctgaatattgcaaaaggtagcccggggattgccattgtgtcttttttgctactgcccatgtagccaggtatgaacagggcatttcgcatgggcatgaggcggggactgtaaaatattactacctgttcaggagacatggctccctgcaacccccggccaagtcctggatgccaggacgggatttcatgtgcacgccatctgaagctaccagcttgctcactacacaagtcgacagactgatgtgactgtatgcagcgctgagcacaacagccggggcctgtcacccagctcaccagcagagagccaggggtgttttcaagcagaaataatgggccactgtggctttttaaagagatatgatttatctctgggaccgcatccaggctagagctgctggaggacaatgacaggctcctgggccagcgaggaggctttcacaccttggcttgtctgcagacggaggacagctggggcttcgcaggctgaggcacccaggggttgtggtgatcagcagggggcacagagaagcagccaactctgcaccctgaggagggtggagatttggagaatttctgttggatttgaaccacacgacggttccttggaggaaccgggagtccaggtggaatctttgcaggcagggtcatgtggtttggccgccttcattactcaaaagcaggaatctgtgtttgggaagatgtgaattacgtacttttgattgaaaacagctgcacacccacaaatccctttagccagttaattggaccatgacaggcactccagatgtctacccacatgcccttttcttaccaacaagaccctgatgatcacgcgctccctggatggtgcccagctctctggctgctcatccttgtgtgacacagctctagccagtggtgggggggtgcgggaaggagggggttgcagaacaggcggctactagggattctgggtaagtgtggccttctatttaagccccttcctcctctcacctcctcctttctcctctcctggctgaaggcagacaggaggccaagagcggcagcaccagcagccacaggaggcctcaaggtgaaggcaccagctgaggatggtggcagaaaggcagaagaagccaggctctgggcgatatcctgcggccccagacttcccctggaccctctgcccctggacctgagaatctggaataaggcaacgtccccccggagatgccaccatgcctgggcttctgttgctttgagctgagcacagccctgggtgatggagagagacagtagtggtcaccctacccagcaaccacctgcacaggtatacattccaggtcggctgaagcactcaaagctaaatccagaattcacaagccttcttccacaccaaccatcctattccttcaagattctttggacatgtggctgggaatcaccggggacccatccccttccacccaggaatctgtctgcctcctgctgcctttcatggcacccgggctaggcccagactttgcttcaagaatgaagctggcacccatagtagggagaagccaggcagcaggagcaggcacttccgagcctgcgatggcaggagggcctccctgggtccccaagagtgcagggatgcccgagtctgcagccagggtttgggtgactgcagctgtacctggagggggctggggggcgggttgcaggtggtgaggctcctgcctgctgcatggagcaggaggcccgggtctgcagcgacagtttgggcagctgcagctgcacctggaaaggcagggctcctgcctgctcccagcccccaaagagcacagggaggctcagatctgcagccatgacttgggctggtgcaacccctcacaggagggtggggctcctgcgcgctctgtggagtgggaagcccaggcctgcagccgtggtatgaatggctgcagcggcacctggggagctcctgccccagcttggaaggggcagggctcccacttgtccccagctcctgtcaactccatggagcggtcaaccccggctgcacctccctgctacagctggtgtgatggcagtggcaggccatctggagaggctgctgccatcagttgaggctgaaacttcatcggccccttgggaaacctccagcctcccagaaaccaagagaacatttctgcctgctgagtttcccaccacgaccatcctctgtgggcctttcccacctccacgtggggccatttccttcagcctaattcactgggctgtcagggaactgcagctggagttggctttgctcacttctggccaggagaacacattctggtctgttttaacacctaaatgacacacgtatgccctgcgtaatgcagaaatggaaagttcctatttgcagagggaatcgtaggcatctttgtgagcttttgttcaaagtaaacaaacctccagcaggagctccttgctgggaggtcagactctgttgctgcagctgctttgagggcccccaagcaagaaggaattctcctagcagatgacctttgaactcaacagcaactctgccctgggtctccagcctgctggcctaacctgcagattttggacttaccgagcctctacaatcatgtgagccaattccttaaatttctctctctctctccacgtgcacacacacacacacacacgcatgcatatatatatacatttccctttagttctgtttctctgaagaacattgattaataaatacactcactttcagtatggacataatcacatgtgccctgcataggttttggagctgatgtcacaagaacaaaattatatatatgtgctttgttagtagtcatattaatcattattactctaaccttggattaaatattaatttgataattagtactctgatctcacattttcctgccagctttatcaattattgacacaggactgggttcacatcagaggaccccaaatccttcagagacatcagggttaaggtctcaagaggaagcagagttcaccccctatggttcaaatcagatatgaatgaagggaccctttgcagaggggcagtcagggctaaagaatgaattgggaagttgaggcacacagagattagcagcagtcagaagctgttaccatccccggggaggatgggacaaggagaagaagcagccacccacctgaccaatcatcagggaaggacagagggaccctgagagacaggatgctgaagcagggggccaggaaagaaagagcgccccccctttgttgctcctctgccccctctcctcctgctggtgtctcccattgactgaaactgacccaaagccacaggccgagggagcctggcaggggcctgcaggacagaccctgggcacagagcaggcagagctgaggatggctgtcaggggtgagaggtgccgggaggggagcatgactgcccagtgcagggccgggaaggccactccagaatgagccagcaggaggaacatcgaccgtgggtccccaagggaagggcctccctcgaggtctggaggagtgaccgactctgctagggagctgcaccagtaatcaggaaaaatgatgtcctacctcagcttccctttgctttttccagacagcctgaaaggctgcagagacgggaggaggtgttcaaacaggcatggccaggtgagccagcagacagttcccctctgtggctgctctggcaacacctgggggtggcctcaaagcagcctcgggctctgaacccctagccttgctccaagaccagctcagggagaccagagagcaaggaacatgcagcacagagcaggtcgcagaagcagcaccaagcaagcccagctgcaggtcacccgggagcctccggtccccatcccacgtggcctggcctgcttgctcctcactctcaccaactcttccctttctctgaggaggaggaacctgggccttgggctcagaaggcgggccctgcacttccctctgagcattcccatctctggcaaaatcgcccattacatgcagaggtattgctaatgggcctcctagtcccacagggcatcacctctgagcctctgccaggaggccgggcaccgcctggcatccctgagggcccttccaggtgcttatcgcttccctcctgcgtgggagtgaacaggacccacagcctctgccccagccactttaacaatgagatcgcacagtcctgggaagcgctgagacctggtctgagacgatcagatgctccgtgaatttctcgtcaccctctccgtcaccccctgctatgcgcccctgttgtcatcctgcagaccccagaacatgcaaggaggatctttccacacaaaagtcatttctgcgtacagtttacctgctgttctgtcactcgttgggagaaagactgtcagagcctaacagctctttaaggccagcatatttatgtcaaaaccaatcctgaagccccaggtcaaattcacagtcaaatggaaaaagtgggaagaaagagttttagcacctatcacagacctcccaggagccacgttctgtgctcgaggcttcgctgacattaagttgaatcaaatgaaattgattttacaggtcataatagttacatatgagcaactttacatggtcctcctaatattgtctcctgactcctcgaaaaacacttccaacttcactcactcatgcagtggatatttatggaacatctaccaagtgccaggcctgtgctggtgccagagatgggggagtgactgggatgggcacggcccttgtcctcacaaggctcacagttgaggagggaggcaatcaagggaccatctgcccaggcgatcctgatgctacaaatgcacttactgcttttctcctggtagaatcccacaatggtcaaagcccagaagacctcacttggctgtggacaagaagctggatcttataaaccttgatgactaaaggtagtgctataatagactatggtcaggactgtagagcatgggggacagggaaggggatttcagggcaagatgcagaatagcgttgagaagccaattcctcatcaagtgctgtgggtgtacaacactcttgtctaagctgagtggaaggggaaagagaggctcaagttattaaaactgtcaagttgaccaacagaagaatttaaaatggtaatgtccttaatacatctcaggatggggaaagaaaggtgagctgccacaaaggagctaaaatgttcatttttcatcatgagagcgctgacgtatgttatctaaagatgacaaagctagaactaggttgtctgagcatattatctagaatattggcaatgaccaccagaaaggctagaactagaagttacaagggaatcaatgcctgggaaagaggaagaatttcacttttcattgattgccatgcttctctgtgtggttgtgtttttttttttgttgtttgttttgttttttgttttgttttgttttgttttgagacagagtctccttctgtcacccaggctggagtgcagtggtgcggtctcagctcactgcaacctctgcctccagggttcaagcgatcctcatgccttagcctcccaagtagctgggattataagcacgtgccactgcatccggctaatttttgtatttttagtagagatggggtttcaccatgttggccaagcttgtctcgaactcctgacctcagctgatctgcccacctcggcttcccaaagtgctggaattacaggcatgagccaccatgcccggcctgtgtgatttttaaagtaagcatgtatttgatagttttataattgaaaaacaaattaaaagtaataatgctctaagtaaatgtgcacaacttacatagagtatgtacaaaagtacaagaagtgggtaattttactctctggggatcctagtttccacccccactgcccctactccccagagatcaccatgagcagtggcatccgatgggataaatgggatgacagagaaacacggctctgtccttccacaagcatttatcccgtgggtgctctgagccatgcgttgcactaagccctgtgtggtgagcaaaatgaatgggaaatagctctttctggggctttaccatcgtatagttcacagcactgcaaaaatgatcacaaacgtcaaagttcttccttctagttattcaggcgatgcaggaattcctccacacatcccaccaagcatcattcacctcttgattaccaccagtgacagtgagctcacttccttcccagggagctccaatcatcattagagttcagttagaaagttcttccttgtgttgaaaagaagcccaggtccccacaactaggcagcggctgagaggtactaagggaggttttagacctaagtatgatttccatttccctccccaagctaccctcagataatcctagaatctatctccagcaagagtgcttagtacaaagggagcttccacgaccctgtggagcccccttcaatgggactgtccccctgagccccaggagagaaatgtcggcatccacactgcctgaaacttccagccatcatttgggctttgagaactgcaaccctctggtgggtgtagactttcttgagctacaatccagcctctcctgatcatagcatccctcatcctgtatctaggatgctagagcagccctgcctagcagggctgcagtcttaagtgatggatacaaggttggccgggagcccagagtgcagacaggtgttgagccctgagcttcctttgcagtgccttcctcttccacataaaggctgtgtctgtccttcaggtgtctctcctccacccattacaggcagccgggcttctttctgactcggggatcactgggtagttttcagcagctcggcctgatgcatggctcatgaaccctgtgttcatcagagtgcacaccttccattacgaacacacccctccagggggcctgacggcctgtctttggggatgtggtccctggagctcaagccagttaggagctgtctgggcctttagtgattgctcagcttccctaatccctagggaagggcagggctcctgcagattagacccagggctttttctgatatttctgtccaggattagaggccacaggcaaggccagggaaggcaaaggagggagaccctgggctgcttttgagaccctgaggcaatgggttgggggttcatcactgccctggagcaggaaccacgaggtgatttggaagacaagggggtagagggtggggcaggaagtcagggggcaggggttctaaccctggggggacagaggaggcttcttcatggggggagggagagaagagccttgggtcctgatgggcaagaccaaacttcaaaccctaaactgtgctctctctgcccccacatcgttcctgaatctgcccctacctgaaaacaggcagctacaaggggctggggcccagcctttgcctgccttgtggtcgcccttcctggggtgtcgctctcctccaggtggcccagtatggcttgccacccggtctgcattccagccagtgggtgggggaaggaaggagacactcgtgttgcaggatgcgcctggacgtcagacccatcccttctctttccatcctattgaccagaactgagtccagggggccaccccaggatgagggatgccagagaaggtggacttcattctgggcagcctgaggttctgttgatatcaaagaagagagcaggagcgttgagtaacagttagacgtgtctacaaagagacatgtggctagataaagtatctcattctcgggccacctaggccttgcaaagctcaaggaaaaattaaaacgaagcatttccacatctgtagaaatggtccagccatttccacatttgcttcctactggggcccatgcagaagctgggtccttgaaaccctgctgaaacaccctctgagtcacacatgctggaggtaatgccacctgtgtccaccagagtcacgtacttcctcttggcgaaaagaagtgctgctcaaaaaagacgcatttagagaatctgtcaagatcccctctgacactgaagttcttatttgattaataagctaacaagatgcatttccattctcccttgactttaacagaattgaatctgttattccatgcatttttttttctggagacagagtgcaacacagtggcttagagtatggatttcggaggtaccctaacctccctgtgcctcagtttccttatctgtgcaatggagatgataataatctcaggtatagtggtgagaatttaacaagggaattcctatgaaactttcagaacagagcccagcatgcagtaggcatgaaataatgttcgtagggagagggtagccagtattttcttcccctctccccggtggtcaatattaaccagtattttcagcacacacattgcagacttccaccggactgcccatcaccgtgctctcccttagcccactccctgaattctactcgggtgtgtgccagcaacttaacatggccgcttctctttctgtagctgagttggccaagcgctttgacatatgtcacctcagtctgagctcccagcagtcatgagtgatgagtattaggaatttgctctattttaccaaggaaaaaaccttgatccctagaggaaaggtccttcccacagtcaggtgcctgtgaacagccacagcaagactcggatccccggctctcccatgagtcatccagcatggtgggcagccagcagctccgtgccaggtgctgccataggcgctgggcacacgggttcttaagtcaggtcagtcccttcctccttgagctcatacacaggtaaggagggagagagatgttccccaactcatcacgcactcaagttcatttcagatggtggtgaggggtcctgagaagaggaaatggggtgacatgctaggaagtgcctgggtggagggggctcctggagacagggtggtcagggaggcactcacccaggaggtgacacttgacagagccctgaaaagtgaggaggtgcaaccatgcacagggctggggacaggaacacggccacacaggggaatgaacctggccgtttgtggcacagaaggaaggtcagcaagtccaggagaaaggggaggagaagagaacaggcccctggcgcctgcacgtctggaagcatcgccaagtttccaagcatctttccagggcagagaaggctccactctgggcaggaggggcttgcttcaccagcaggaggagttggggagcaggagggagtcctgatgtcctggctacaagtccagggctggaaaaccaggcgggcctccgccgaggctgctccttccccattgggcctccgctatctggttggggcatctcagactgaggagcaggaagtgtgactgtcgcaggccaatgtctgctgacgaatctcccagcccagatggtgggcctgcggtgggcttcctggtgcacgcggaggcgactctggcgagggggattccctcccctttgaatttcctcctggttctgcccacgtgaaactgggctggttggctgggcttccttttctctatttggctttcttattctccaaataaaagacgaaaagtcaaaacataggcataatgcagaattataacgcttggatttgtctaacttcatccctgcaatcgcccaaatattcacatagttcaagaacaccatcgtataacaggctactcagggactgtgacatgatgacacttgtaggaacccagtgtgtcatttagtcctctgtgtgtctgtgtcccattctgtgggtgtgcacacaacaaccacacacaaactcaccggttcccttgtgtgtgtttagacaacatgaaactttgcatcacaaaaccaccgagtgatgtcagaggtgccatgaatcataatgacagctcctggcctggtatccaagagacctcaacatgctgctaagtcactgtcccactccatgagaaccggtcactctctttgagcctccagttgaagggaactaaattaatctaggatgacccatattgtgcagcagctaatgacccagttcacctctggttaattttctgcttctgggtgtcctgggaacgggtggtgtttactccagttgggacaaacctttattaatgagccagagtgttggctgctctgggcggagtgttttaatagaaatcggccaatgggccagggcgtgctgaagttgcagaatatgaatgaggcccttttctttgccctctctctcttccaccctgatttgcataactaagctttctgcctttttatctttttaatgtgtttgtttgttgattattgatctgtcccctatggagggacaaatcattcgcccaccaggcagtgacctaaatttggcagaagccccagccatgtctgcagcaaactggagccagacagttatacttgtatttgtagggacaattccaggagaatttatatggcccaaggttgtaatgatcaaaattacactggcctccagcagactcattaaggggaatcttggcaaaggaagacttgatgagtaagaagaaaagaaaagatcctctttcatggtaaaagatctggcttaatttaacaaaaaagctcaaaagcctctccaaatgaggctgcagtttccctggggaaagagaaggtactgctgagttttagaaatgtggttctcagctgtgtccaaacctatgccaccttttttaaaccaatattttataatttccacacttgtatcttgaaatataattcataaatacagcctatccacatctttttaaaagttcaatataatgccctaactataatataaagacagaagtataagaaaagtaatttatgtaaagtaatttgtaacaaattaatgcatacttcaacatgcaaatgctctgactgaccgcactagaagtgattaagctgtaaatgcagactggtgacaagcctgttgagttgccacctcaaatgtcatgcacattgccgctagtgaggagagggctcaggatgctgacccgctggtggtgaacttctgaacaaaacaaacacgagtttcccttgatttacaccagagttgctgtcccaggaaagtcagtgattattaaaacattatgatcgtctctatgtaaactggacttttcactggaggctcagatcattgtaaatagggtttgcttacatgaatgtccagtgaaacattcaaaactagtgcaagatacaagataaattctgcatggtgtgggattgtcctatgtattacagccgcatagtatcctcagctcacaccccaaatgccaacatcacgctcctctcagcattgtgcacccaaagcacctctttaggggcgagaccgtcattgataaccaccaccccttgcacagccgcgtgtgctcacagaggctaaaatctactgttgtctccacctgaagtttttcttgtcctgtaacctttccctggctggctctccaccctgcccaggatgaggcagggaatccaaggacactcagctacctcaggtctcacccaccctctccccctccccaggcagagaagaatagagtcctgaaaccctgtccccagagagtgaatcaacctcctgggtctgagggctgcacacacatttgttcctggttcccccagggcctgacaacctcactcctattcctctgtcttgggaaatccctcaaagccaactgtaccttctgtgtgggtcttgaggtcctccaccaaggggctctttcctttttatcagtttgttcattcacttgtatattatctttgttaccaaaatatgtcaagataatcacataagtcaagataaaaatggccaatgcaaccacatcttgtcaacttggtgcatttctatgtacatggtcaattttcacacacagggagactctgtctacattttctcccaggattctaccacgcttccttttcaatccttctctaatttccctgccccctgcctgtctcctccttcccaaccccactcccaaatgtgtctccttccacaactttctacacacttctacacaggttcatacacaggcatatacacactgacaaggatttcctgacctctctttataagggcttaggtttcttttgcaaactataatctgactacataaatacttcatactgtgttttcttaatcctcaatatggtatagacatcatctcaattgatatatcaggatccaactcagtatttcaaaataaccatctaatattccataatatgaataaattttacattaatcaaccattcccctgctaatggatattcagagtgttttcagattcaatgattcaactataatcaactaagtatgatcagcactggaataaatatctttgaatatgtattcttgtactgtagagctttggtttctatgggatacgtttctaaatataggatttgttgggtggaagaacatgcatatgttgaagctagaggcactggagtgatggattctgcctagggcaagacaggacttgattcttgctggaggagccatctgagtttgtgaagggcaaggagagtgcatgggccgagaaaggtgctcccaggagtgatccctaaggcagccaacagtaccccactgtgcagataagagaaagaaaccgacgcaaaggaagtcttcctaaccaaattccatagtgtaaaaagcaatgatttggaaattggaaggcctggactctgacttggggtctggaattctctctccaggtgaccttgggtgagtcacttcccctctctggctctagtttcctcctctcttcaaattaagcagctgcactagatgatccttaaggcctcttccctgtgaactttgtatggttcaatgagaacaatgtatatgatggggctttctgaactctaaagtgtttaatgctatgatttgtttggtagatggtaatggattcttcttatgatcatctatgtccatttggttacgtccaacactttcctttttctcacaccccacacccaatcccataagcacctcctaatagctctgcttccaaagtagattctgaatctgctcacttctctcttctctaccctctgccacccccacctgcacccaacctgccatcatctctcatccccaacctcaggacaactgcaacaaccctggctggtcacctggtctaccaacccctcataatccatcctgcactcagcagtcaaagtcagtttgtaaaaggaaaataagactatgttgttcccttgcctaagactcccagtggtttccccaagcttttagagtaaaatccagtctccttactgtggccacaaagccatgcatgatgggctccttgctgcttctgaaacatgctaagttctttctagtctcaaggcttctgcacatacttttttctgcctgggacacttagcccagatggctgcttctcaccctccaggtcgcagctcaagtgtcacctcctctgagaagcttttcacaaccgccctgtccaaaggaggtgtgtatctccatcactctctatccccactctgatttattttcttcaaagcactcactgcaatctgaaatcatcttattcactgtgtgcttgtctcttgctgtctccctactagaacagaagctgcatgaagacaggggtctcatctgccttggacatcactgaatcctatgcacggagcacaatgcctggaacgggaggagctcaatggttactggttgaattaatacactgaggaaatggatcagctgtagacaaccttactttgttctctcatatctctttcccacctgctggccctgcctttccatttaaatccagagccaagcacacattccttactatatatttttttgtactgattaaaatgtttcataaacttttaccacatatggatcagggcttttagttgctaatggaacctactccagccagttcaattaggaagggggtttatttatgaaatcctattgggtagcttgggctcatgcctaccaaagaattagacttgcaggccacacagccaggaaacatggcccccaaattacacaccccccaatcataactggtcccctgatgtctctggtgccttcacccagcacacacatcccagcccatgctgccaatagcacaggtatgagacactgaagatgtatccagaatcctgcaactgccccctgagggactaactgtagctccttccatagaaatcacccatcagtggttggcaaaaaggaagaacaaatgtccactaaactctttaggcaaatgatcacagagagccattgtgtcctcctagccactgcgctcatcacaccagagggctgttctgaaccatccccagttaccccagttaccttctgtttgagtcaaggttctctaaagaaacaggaacactagggtctgtgtgtgtggagggagacagagaagagacggggagggagggagagagagagagagaaagaaagagagagagagagagatttattgtaaggagttagctcacatgattatggaggctgataaatcccaacatctgtcgggtgagttgcaagctggagacataggagagccaatagtcttctagtccaaaagccagcaggctcatgaccaaagaaaagacaatgtctcagttctagtccaaaagcaggaaacagctgagttccagttcacaggcagtcaggctggaggagttccctctcactcagagagagtcatctttttgttctattcaggcctttaactgattgcatgcggcccaccctcctgagacaggcaactggcttcactcagcctaatgatttaaatgttaacctcaccaaaaacaccctcatagcatcactcagaataatggttaagcaaaatatctgggcactttatggtccggtcaagttgacacataaaattaaccactgtctcttctagggctggtgcaactgacagtgataaaaaaaaaaaaaaaaaaaaagccctccaggcctctgagctttgaacctgtttcccttaaagcaatgaggagatgattgaactagtgttggaggagtcacacttggaatctaagtggcagtgcctcaaaaagggttataggctcaacctcagagccttgatgatccagatcccacccgtgatggggaatgggcagagaatggctcccttaatactgcaagtgaggtaggagatcagcaggacttgttttccaagcacagatcatgatcctgctgatcgaagcaggatgcagtaaagcaactggccaaaaccagcagatggtggcaaaagcgatctctagttgccctcactgctcaatagcataaagacactcccacctcctaccagcgccaggacagtttacgaatgccatggaaactatccagaagttaccttatatggttctgggaaccgtctgccccttttccagaaaattctaaataacccaccccttaattagcatataattaaaagtggtataaatacagctagccctggtcttcagggactgctgctctgggctgctctgcctatggagcagtccttctgctgcacactgctgctctaataaacctgctttctttcactcctggctcactcttgagttctttcctccacaacaccaggaaccctcccaggctgagccccagttttggcattaacctgcaccacaagaaacaaaggtgtccctccctccctccctttcttccttccctccttccttctttcttttttcttagggtgttctagaagggcagaaatccatcttccctccctcccttcctccctccctttcttcctttcctacttccttccctcccttcctcctttcctgccttctttcttttcctcctttcctccctcccttcctcctttcctccttccttccttctttctttcttcttaaggtgttacagaagggcaaagtccatcttctgttccttccttccttccttccttctgtctttcttcttaaggtgttacagaagggcaaagtccatcttctgttccttccttccttcctgttttcttttttcttccttccacacacatttagagaccatcttctaaatgtgaaggaatgtcctagaagcagcagtgaaaaaacagacacagtcccgccatcatgggcatcctgagactgtccacctgagagctttctcttaccctgtggccagaaatgctgacagttgatggccctgggacaagccctcggctaacggggcaaagaaattggaggataaacattcagctggtagaggactaagctccagttgcccacagtggcaacaccctgtctcacttccccactcccctgttggtatttcctgggaccacctcccacataaactattatattaggttggtgcaaaagtaatcacggtttttgcataatggcaattatttttgcacctacctaatacttgcactaaaatccttgtcttgggatctgcttctgggaaaccaaagccaggtggaaagcaattgggaacatgggataacttgatagagagtgggcaggggtgagcaaggagctgtcagagagggcagtccaggaggcctccctgaggaggcaacctaggaataggagctgccgggtgaagatgcaggggaagggtgtcccaagctgaggaaatggcaaggccccaaatcagaaacgagcttagcatactggcccatacgcctctaggatgaatctaaatgggacaagcactaatagtattaataagaataggaatagcagctaatgcatgcatagcaccaactgcaggccaggcactgctctagggacttgatgcacatcctcccagcagcctcaggagacaagtgtgatcattgtcctcattttctgggcgaggaaaccaaagcacagggagatgacgcacttggcccaaagtcacccagctagtggtggggccaagatgttaccccctccgctgatgatggcagtggcaggtgggggaggtagggctcataatgtattcacccctgatgcctactgtgccctgcacagagctgcacatggacacactgcagaaccatgagcagtaataacaggggcattcatccagcactaaccctgttccaggctcccttctaagagttttaaatggaccaattcatctaattctcacatcaaccctatgaggtgagggctgattgtcaccatgtgacagaggaagaaactgaggcacctagaggttaagtcatttgcctgaggttgtgggccggtgagtggctgagccagaattcaaatccaggttatttgacgccagagccctattcataaatgctgtaagcatgcacacacttgttggtgcgcacatacacacatgcacatgcatgcacacataagatatgggaatttaaccccagagagagaagaatttttctactggtcacattgtttgtaagacacagtaccaggatttgatcacagtcagctgattgcggaggctccattggaagggaagaaagcagatgatcaaattttgaaattacagagttcaggatttcatgctaccctagtccctacttgcatgtgattataaaccaaagagctgaaattcactcacaattagtaagaacaccctcacgggtctcactgacgatgctctgcacagcctggaggtcagcactcctcccgcagtggtgtttgcctgctgcaggctcctcatctgtgaaacggagtggacagggtcagccctctgcaatggctgtttggagcacgacataacctgtgtaaagtgcttagagccatgcttggcacacagtaagtgctcaataaatgtttgctgatataacaaatgccccatgcataagtagtttactccctaactccccagcacgagacagaccctgtgtgccctccataaataaaagctatggctgaaatcattgtttctaagcctcatttttcccagtgcccaaaggaacagttgcacgtcaaccagaaaatcctcccagcctttgttttgctgtgctgacccatagaatccaaggtcacatgattttttctttcttttgtttgctgtttcttttctgtatggaccaacaacaacaaaaagataacaactgtacctgggttttgtgttttaataattttaataatgcacaggaaattggatggcttagggactctgcgtcaaatgagtgagtcatccttgtcaacagaccaagtggaagcatgagactcaagggcaggaaagagaagggcccaggggatggaaattgaatagtgtgatgggctttaacaatctaaattaaattaaaacttgtcagtgctttcttcatatcacaagtttccagttagagaaagaatgggcccctccaaacagtgagttgaaaaggatgaatttcattctctgcatccccaagaccaacgagatgggccctgcctgtctcttccacgacaactccactcttctctcattctcggccacactggcgctgctgttccccaagcatacccgcatggctgtccccacctcccagacttgaacttgctgttcctctgctgggacctttgcatgtctgcctcatcccccacattcagggcttagcccttacagcagtcagaggggctctctgcccccactctgtatctaaggggcccaccctgttgtccccaccctccactagtccatggccctgttacattttcctcatagccctcatcactactctattttggatgcattctcaatgtgcactccaggagggcaaggatctcatctttcctgcttgcctctctctcccaaacacctagaacataccaggcacatagcataggtactgcatacatccttgtttggtgaatgaacaaatggatgaatgaacatcttggtcactatctctccagagccaaataaacctttgtaactgagtcatttgcctagaactgctgagtgctcttccttgaggcccatatgaacccccatcttgctggttacttgacctgattggcaacagcaacaccccacagcaatgggcactgtccattctccaccccacatcctggcagccctgggcctgccagtgtgaaggcacaggaggcagccatgggaacgcgccacggaagtgaaaaacttttcccagcaccatttctgtggcctagaaaggccctaatgatattttctacttttctttgctgaataaattgggcagcaaatttcatgcacatgtgctcagtgatcacctattgatgccttgaacacagatgtttgattctggcttttttggagccgttgctagactgagagttccatgagggcgagggtcgtgttgcatgcatcttcatgtctccctttcatgaggcaggagctcagatgacatctcaggtgtgacgtcatgtgatgtcatgtgtgttctgtgagagggacatgaaaagccaacagagtcatctagaaagtttggtcactctggggatttcccaatcagagcaatcactttttcttaagcagcagatctctggtcttacttttttgttgttatacaatattcatttctttttttttttttttttaagagacacagtcttgctttcaaccaggctggatggagtacagtggtatgatcgtggctcactgcagcctcaacctcatgggctcaagatctcctcccacctcagtctcctgagtagctggtactacaggcacaggctaacacacctggctaatttttaaactttttgtagagataaagtttcactatgctacccagcctggtcttgaactcctagcctcaagtgatcctcccacctcagcctcccaaagtgctgggattacagacatgagctgctaggcccagcttgttaggaaatagttcaagcctacagaaaaatataaagaagaatgtaatgaatatctgtgatcccatcgaaccagctcagtgaaagcttatcatgctatatttgcttcagatttttttttcaaaataaaacacatggaatgattaatgtccctggtgccccttctaccgtcccttctcccaccgcccacaggtccacacttggtgctccttgttcctctccagggctttatgctttgccacacatatgtgcctgtaaacattacactgtccagttgatgtgtttaaaccatacatgaatggcttgtcactttcaacagcttgctttcttatttaaacttaactcccataacacactcactggatgtatatggaataaccaaataaaagcagacaagctgtatcatgacaggacgtgacaagtaggagggagggtaatgaagtggggtacaaggatgcaggggagacgggggagtgctcagggaagtgctatttgagaaggagacatttgagcagagatctggatgcagtgagggtgtaaatctggcaaaaggcgaccaacccgtcccagctttctggtgactttcccaacactgaaagtctcaggtcccaaaaagctcctcagtctcaggtgaaccggagtacccagggaaagaatgtcaagagtaagaaacatggagtggaagggacttgtggtggagcgagtttggcctgttagaagaagggcccccgaggctgagtggggcaaggagggtgggcagggaagcagaggcagatttagtccactagggagtgtgggcaggtacatgcacagtgtatgggagctgacgtgtgggttagatgccactgtgaattcaaattttactccctgagatgattattttcctaatttaaagaaattatcatataggaaagttgacatttttggtacagatttctgtggatttttttttttttttttgagcctttgtctttttctgtcacccaggctggaatgcagtggcacaatcttggctcactgcaacctccgcctcctgagctcaagcgatcttcccgcctcagcctcctgagtagctggaattacaggtgcccgccaccatgcctggctaatttttgtatttttagtagaggcggggtttcaccacgttggccaggctgatctcaaactcccgacttcaagtgacctacccgcctcagcctcccaaactgccgggattacagatgggagccactgcacccagctgatttctaaggatttttgacccatgtagaaattcatataaccaccaccaccatcaggatccaaaagagtttcaaccccccaacaattgtccggtgccatccctatagtgaacccctggaaactgctgatctgtctccatcactataacttggtttttctgaggatgccaaataaataggatcataaagtacataattttgggacactggctctgcccctcagcataatgcctttgagacacaggcccatggctgcaatgtggtaatggttccttcctttccacagctgagcgtcattctggagtatgggcatcccagtttatttatccattcactcgttgttggagaacattagggctgtttcaagcttctagatttttgtgtcttctggttatttttgagaatttcacagcaattacactctatatctggtaatgagtttcagaaaagtgctttagatggaagttctgctctgtattaggaatatgtccttcactgattagcatataaggattttagggaggagattctctccccttccccatctcctgatggcagaccccgaatttctcaggatgttcacttaaaacagcatatttctaagccttgtttctagctctactacgtgagtgaggtaatagtttctgccctttccttttaaatgagccataactattttttaaaataatacatttctcatatatgtcttcttttgaaaagtgtctgttcatgtcttttgcccactttttaatgttttttttaattgtaacaaagatatggaatcaatctaaatgcccatcagtgattgactggataaagaaaacgtggtacatacacactgcaaatactatgcagtcataaaaaaataaataaataataagatcatgtcctttgcagggacatggatggagctggaggccattatccttagcaaagtaacacaggaacagaaaaccaaataccacatgttctcacttataagtgggagcctaaagatgaaagcacatggacacgtagtgaggaacaatacacactggtgcctttcagagggtggagggtgggaggaaggagaggatcaggaaaaataactaatgggtactaggcagaatacctgggtgatgaaataatctggacaacaaacccccatgacacaagtttacctatgtaacgaacctgcacttgtagctctgaacttaacaaacaaacaaacaaacaaaaatacgttttattatgtaagtaaccttaaaatgagaaaaaaaatccaaagatcaaagactggttccttccattccaagtagcctgacaagaatatctaggaaccaggaaaccctagcttcccccgcagtccagatggaaggaattgggcttacaaaagaccccacagggtctcactgctaagactgtggtctgttctgtttatgagcttattctgtcaaggcctgttgggtttggttttgtttaaggtttaacaggatttcagacttagtggtggtctctttggattttctccttctttttccttttgatgcttaaacatacccccacgacaccaaagaaacaaccatggctgaaaagactagaattacacaggatgtaattccctttcacataaacgctgaagagtgtcacccctggagctgtgactttgctgcaaggagccgaaaaatgaggatttgtttaaataaagacacagagtaggctacatgtaagtagagtgtggacttaaggacccctccttggggttgaggcttcaaatcctaagctcccaaaggggaccatttgaaaaacaagaataatttctgtttggccaagtactgcactacatagctgcatttgagagaagaggactgagtctttttaggtttgcgaattccagtttttccttttttttttttttttttttttttttagacaaggtcttgttctgtcttgcaggcagtggtggctcactgcagccttgacttcctgggctcaagtgatcctccagcctcagctttccatgtagctgggactacaggcatgcgccactatacctggttaattttttttatggtttttttttttagtaaagatggaatcttgctatattgttcaggctggtcttgaactcctgggctcaagtgatccttccacctcagcctcccaaattgttgggattacaggcctgagccaccacgcccagcccttcagtgtagtgatctatggtggacatcatacccttctgggggcattttggatattgtggggatggttttggttgtgttttgattggggacactgacatttattcaattattcaataggagtccagggacactagaattctgccacattcaggacactcagacacaacaaagtcccatgacttatccatatcccttagaataattcatgagcctagaaactcactccattttacacagaactctaggtattgatggcagctttcaaaggacattgaacatagagtttgtagtctctgcccacagacaccactgttcctttttccctaactgcctgtgcagagtgctgctgagccgtgtggcttcctgctctttgattggcctactcatcactggaggtgcagacgtctcgctgcttctggggtttgtctagtgtagctacacgtaatcattttcacatatttattataagttcattttatagaagttattattttgtattatctgtattattttataacaagcttgttcccttttccctcttttatattacaattaagacatcatcctgatttgcttttaggttatacatataggtaattcctattatttttgaatttcattttagaatagtaaagcatcatcataagatatcataaaatacagttcagtctaatagggctgaggatcgctgttcccgtggaactctgctatggacgtttgctaagaggcccagaatcggatttttccagcaagaacatcctgattttactgtggggaatatttatctactggacccagtcttgacgaccttgatgggcggtcttagtttggcaaaggttgtttgcactgacatttgaaatccaccagagacccagtgccaatcagcatgagaagtcatcttctcaaagcatcagtaatttatgcaaaacagcacattccccttctattccattttagttcatttctctgttctccttccagctctttccattcctccagaaaggtcttttctgtttaattcctgggtagagatggctccttgtaccccagtgtccttcccttccttcagacagtgatttttagttgggtgcttggtcacctaggctaaagattgctgttcccagtccccctgcaggagatgtgccacctgaccacgatctgtccaaagggatgtgagaagtgagggatgcaggttatgtgtacccttagagatgagtcctgctagccggactctgtgtacccttagatataagagtcctgctggcaggactctgagtacagaaaggaagcatcttggagcttgctgccaaaggtcctagcctagtgatggcaaaacaggaagacaggaggagctggggtccctgacaatggagccgccacagcagccctgggccattgcttttgactattgtgtgctagagaaataaacttctatcttaacatactgttattttgtgtgtggcaaagcgtgtgctcatcacaaacccatttcttcttcctggattcacatggagaccacatttccagcgtcctctgtatcaggtgcaggtatggagtgtaagctttcatggtggatgcttcagggcatccagaacaaagatgaacgccccacagagctatcttgagagccacaagctgaaggtggcagtgccacaggagagaaggatcctgggtccccaaaccacaggggggcactccctacacacaaccaggagcattcgcttggacaattagaggaacaagaaacaaacctttatttggtaaagccactcacattttggagtttgataccttgtatgaccttaattaattcaagtttatgtcccagctctctacatcctaatcaaagagccctgagcacacaaaagaaaaagatctaggtctttctggaatttctgcataaaatattcataaattaattggtagaaagaaacctgtcagtcatccacttgcacagcaaatacccattgagcttcaacttgagcacagtggtgacagaatggaaaaggaacctgtagggtccctgctctcctggagcatatgatggggacagtcagcggacaggtcagtactgcagggatttttatggaaggaggtgtgttaatcgaattttcgtgaaacaaatcacattctgacttcctgccaatgatataattttattttctgctttagaaatctttcttggtgtaaaatgatgaatgctttcataatataagcaacaaatccccactttttcttgtttcatcttctgtaagttctggattctttgtctggttttctaaaggcagtgcactctggttcagcaaaggttgtttacattgacattttaaatccaccagagacctattgccaatcagcatgaaaaaccatcttctcaatgcatcagtaatttatgcaaaacagcccattccccttccactttgtttcagtttattctgaggctctggccaggcctctgtcaagcctggtggcatctttcaggcgtgcacaaatgacctacagatacaggggtctccattctcatggtgagactgggtgaactcccagatgttcccaatgcatcccttctggtaggtttctccaggaaggtacatcctgcagagccatcctttggcctgcaccatctcattctgaatttctggctcagaagtcaacaaactacagcctgtgggccaaacctgattacacttgattttgtaaataaagttttattgcaacacggacacactcattcatttacatattgactgtggctgcttttgcaataaaatggggagaattgagggcagaatggcctccacaacctaaaatatatatatatattttgtccaagatggagtctcactctgtcgcccagactggagtgcagtggcatgatctcagctcactgcagcctccatctaccaggttcaagtgattctcctgcctcagcctcctgattagctggtactacaggcatgcaccaccatgcccaactaattttgtattttttttagtggagacggggtttcactgtgttggtcgggttggtctcaaactcctgacctcaagccatcgcctgcctcggcctcccaaagtgctgggattacaggcaagaaccaccacacccagccaaaatactttctattttataccctctggttctttttagaaaacgtttgccaactactgacctagataattaacttccttggttttgcctaattgccctggtttgggtaattctgtaagtgtgacctctggctcctccttaccctgcatcttgaagctgaacttgagtggatggagtttctagttctttaatgggaatttggctcagagtcaatagaaagaaaagaaaaacacactttttaaggttttatattttattaaattaaatcggattgaaaacaaaaagcaacagtcctcaggtcctatgttttcaccttcagtccatgcctagggttgaccacttttgatagtttcaaattttttggtgcttctggaactctaaatattaaccttcaagttctagctctagacttgtcaacttcagagagtggctattgactaggaaggctgacatcctgccaatgatataatttttattttctgctttagaagtagtggagcttattagttcacttctctgaagctaaacagtctggatttgaaattccaatactaatacgttctggtaaataagttattttacttcttttgaccctctatttttacgtctgtaatatggaataataatagaaatggtctcatagtgtccttgagaagactgcatgtgttaattcacgtaaaaccaaagtgaagagcttcttgtatataagaaacagtccgtacatgatgattcctttgttttttctttcacattttaagtaacacttgaatatcttttttttttttgagacagggtcttgctgtgttgtccaggttggaatgtaatggcatgatcatggctcactgcagccttgacatcctaggcttgagcgatcctcccagctcagcctcccaattagctgggactatggacctgtgccagcatgcccaggtaattttttaaattatctgtagagaaaggtctccttatgttgcccaggctggtcccaaactcctgggctcaacgaatcctcctgccttggccccctagactgctaagacaataggcatgagccactgcgaccagccaaacttgaaagtctttctttcttcatccatctatggacataacccttggctccccagttaccagatgataatactataaatgtacacagtgcctactttatgtcaattgctgtcctgagaatttgacataaacattaatttactataattggcaactgcatcctccagttgctcaggccccaaaccagagagtcatcttggacttctccctttcactcagcatatgcactccatcaggaatcctgctggcttcatcttcggaatgcatctcaaatccagtcacttcctaccccgtccacagtgccacccaagtcctggtcatctctcacctgaattatcacaacagccaaagtacatgctagcatccttgtaatgatccacaaggcacttacccctgagccctggagcccctctgtgcattgccttccattcccataccattccacctaccatctcccctcccactgccccctagcacactcccttatcactccccagtcactctgtcactccaaggcagccacagagggctcctgctattcctgcacaatccaggcacacccgccctcatgggctctgtgcctgctgtccctccacctggaatgctgttcccgcctataagaaagtagctcactctggtcgggtgtggtggctcatgcttgtaatcccagcactttgggaggccgaggtgggtggatcgggaggtcaggagttcgagaccagcctggccaacatggtgaaatcccatctctactaaaaatacaaaatttagccgggtgtgatggtgcatgcctgtaatcccagctactcaggaggctgaggcaagggaatcacttgaacccaggaggcagaggttgcagtgagccaagatcgtgccatcgcactccagcctgggcaacaagagcaagactccatctcaaaaaaaaaaaaagaaagaaagaaagaaagaaagaaggaaagaaagaaagaaagaaagaaagaaagaaagaaagaaagaaagaaagaaagaaagaaagaaggaaagaaagagaaaagaaaagaaaaaagtagctcactccttctccccttcaggactctgctcaaatgtcacctaatcagatagactctctaactgatgtatctaatagcagaccacaccatcactctccaaactgttgccctctttaatttttcttaaagccctatcccttttggacactatattagaaatcttagttaaatctttgttccctgcccccctgcagcctgggtctggtttgctcattgtgaagcccccattgttccgccagagctggtgcacatagaaacgcagtgagcatgggtgagtaaatgagtgaagggatccagccgtttgctccctgcatcctgtcatcatgcaacacagtcacaaatggaactccagacagcaagacttctccgcgtgctgcctaactcattccatgagccaccagtggcaggaggatcacaattttggaagcatcaatccagcctcaggtggtttctacctcggggccccggtctgctcaccttagtggacctgcctgatgctggtggagtcttatttccatctggggcccctgcacacacttcgcatctggctgtccctgcacacagggcccttcactgcctaaagctgtgcccacccaggaccacaaccagcttccggggctcctgcccctgctggtctgccccctccctcttgctccctcagttcagggctctggtcctgacagctgtcctcttagctggagatgagaacacaactggcatccacattccacctggatttgcataatcaggcacatttactgccctccctcactctgtgccataattactgacttgctctgcattcaacacttttcaactccatacacgtcccttctccctcctgcatttttaaggtggttattacagatatggcagacacggctttcccagacatgaatctggctttaaaaatgcaaaaagatctttatgcccatttatgtaattatttctgcctctaaaactgggggcaccagcatgtttagtcacttgaggggaggggaagacctgtagtgtattctctacaagcatttgcctttttaaaaaatgcacaagacccttgtttcctgcattttcccaagaggggaaatacctcttggtccctgagagtcagacagggtgccttggccaggatcccatgacagctcagtccgacagaagagcttgcaaggaaggatgatgctaccgtctatggaaaagatgagtgtgcaaattctctagatcgggcttctcactttttactgtaaccctcggttagagatatgtgttttatcagacatggtgtaaacacacttgtgcacttagagagacagagagagagaaaaagcgagagttagcacagaaaacaacagttatccttaccacatacaggcacagggcattttctcttctattgcattctatcctatcaattctgatatatttcattcaatttcatctttttttaatgctggctagatcaactgaattgatttcatgactcattaaggggtggcaggtgtggtttggaaactgtgctgtatgatggcattgtcctttcatcatggaaagccaagcccctccagatatctcacttgacgagatccctagaggcaagctgaactcttttcctctggaagccttgcatcacagcatcaagaaataatagattttgttcaatgaaagattcctatgactctggagatgcagtgagcaaaacccacaatgcaagagatgacctggttgtttcaaaaaataataattattattattttatttatttatttatttttgagacagggtcttgttctgtcgcccaggctggagtgcaatggctcggtatcggctcactgcaacctctgcctcccaggttcaagcgattctcctgcctcagcctcctgagtagctgggattacaggcacgcgccaccatgcccggccaatttttgtatttttaatagagatgaggtttcaccatgttggccaggctgctctcgaactcctgacctcaagtgatctgcccgcctcagcctcccaaagtgctgggattacagatgtgagccaccgcgcctggcccaataattatttttaaaaacggaggatgtgatagattcgtgctgtccgattcggcagccacaagccacaagccacaggcgtccactgagcccttgaactacggctggtccaaactgagatgttctctaagtataaaatacacccctggttctgaagactttgcatgcagaaagattgtaaagtatctcgttcaataattttactgttacatgttaaaatggtactttggatatactgggttaaataaattatcaaaattaattttacgtatttctttttacttttttttttaagttggctcttggaaaattttaaatgatgcatgtgactcacatggtaatattgtggaactgaccaacaatccaaagaaaccaactgaaaaaaattgagaccactggggaaatttgaaaatggggtgtttgaggatatgaaagaaacattattaattattttttaagtgtgataattttgttacaaaaaatgttattttttagaaatatttacagatggacagatgtatttgagatttacttccaagtaacagaatgagggggcaaaaaaaaaaaacaagtaggggatggctgtagctgaaaccagtttggccacaggggctgaggctgggtgatgggtatacaaggctcactccatcattccttttacttttgcatgtttgaaattttctaaaatctgaaataaaattttgaaaagactggagaaatttactacattaaaaaatcatagacaaaaccaaatcaaaccccaaacagacagcatatgtgatcagtgtggcaggttgtgtggctgtaatggtggattctagagtgggacagtctgggtacggatccagacattgcccctcacctgtaagctgtgtgaccctgggagagttatgtaacctctctgtgctgcagttccctccttcgtgagtggggataagaatactgtatctatacagtggggtcagggtactccttccctatgactgctttgacaggctgccattaactctgtggcttaaaactatgcatatttatgatcttacaattctggaagtcagaagtcaaaataggtctacagcagcagtccccaaccttttggaaccagggactggttttgtggaagacaattttttcacagaccagggatgggcacgttttcgggatgatccaagcgcattacatttatggttcactttatttctattatgattacactgtaacatataatgaaataactatacaactcaccctcatgtagaaatcagtgggagcctgagcttgttttcctgcagctagacgggtcccatctgggggtgatgggagatgtgtccgatcatcaggcattagattctcataaggaggacaccacctagatcccccacatgtgcagttcacaatagggtctgcgctcctatgagaatctaatgctgctgctaatctgacagggtggagctcaggcagtaatgtgagcaatggtgagtggctgtaaatacagatgaagcttcactcgcttgcccgccgctcacctcctgctgtgcagcctggttactaaaaggccaccgaccggtaccagtccatgaaacaggggttggggacccttggcctagagaattgtgttccttctagaggtcctctctgttttcttatactttccagcttctagagacagactgcatttattggctcatggtccctccttccatcctcaaagccagcagcatagaatcttctctttactttgacctcctactgtccattcatataaaatccctcaaggttaccttgggtccatccagataagtgaggagaatctccctgcctaaagatccttaatttaatcacacatgcaaagtttctttgccatgtgaaataacacattccacttttgggaatgaggatatagacatctttgatgggacattatttaacccaccatcatggaattgttatgaagattaaatatgttgagcacttacaagcattcctggcacctatgtaatcattaattaggcattaataattaatattatgattatcattattgttatgtagtgttcatattgaacccatcagaaaaaatgttgcagccaggtgtggtttgtaactgaaggaaacttagaaaaagtttaagtaacttagaaaaaggctgttgtatgtcctttgtcccccttcaatttcatttcttcctctttcctgctggctgggcagtgggtgtaatggctggagctggggctaacattttgtaccatgaggcggcccagggaatggaggccactcatggcagatgaacaaaaataaataaatgtggcaccatgagggcttggtagagcacaaccccacacccaaccttggattgtctacctcagcctgtcacacaggagacaaaaataaatttatactgtgctcaacctcttgttatcttgggcctgggtcactcacagcagaatgtaatcctatgaatactttaattttaatctgtttctcatcaatcataagagatgtcaaatgcaccaagaggccacagaatgaaatatgaaaacagtctgtgtctgcagagccaaagggctttgctgtttgcttttcaatatatgggactaagaagggaggtaatgtaatcatcccagcttgtctgaactgaggtttcatttatttcttccttttcttatcatatttttaaatgacatggttcttgatgcagcaaaaacaacatgaaaagaagatcaaactcaggctataaagtcatgtgtggaaggaaatgacgagctcaggtggaaaggactctgtgacctctttgagcccacatccctcacctttcctccttggcctctgttcttctagttctgtgcacataacagctcctctgggctgcctcccctggtcccctgagggaccaatgattctacgtgcattattcagtgtctttcattacgttgtcaacatctacagacatgttgtggacactttgtgttttctttcccaatatccattcttccctcttctgacaataatatttggggctccttctctccctgttccccaattcatgtgatcaagaggtgcctttttcctaacctttagagataaaagcctgtcctgggcaaacacagtaattcatgcctacgattccagcacttaaggaggctgaagtggaagaatcgcttgaagccaggaattccaggctgcagtgaaccacaatcatgccactgcactccagcctgggtgacagagaaagactccatctctaaaaaattttaaaaatttttttaaaagcctgtccctgtatcatattctctgggccacagtgattgagtcagtggctgtcacattacccaagctggtcccatcagggcaagtcttaagacttttatggaagatttcaggagagactttgaggggtgggagaggaggatcaggctgatcctgaggcagcttgattaagcctgaggggaaaaccggaagtttccagaatttctgagaacaaggaagaaaccttgggctaaaggtattagttgagtccctagattgagccatgcctaactcagatttacttcccaaccctatattttagtatgtcatgaaatgcctcatttgttgaaacaactccaacctagggtttctgtcacttgcagtagaaacagtcatacggatggcctgaatgcagatctcccagaagcagccctaagaaagaatttgagtgcagtgggttgatttgggaggcaatgtcaggaagcaccaggaggggaattgaagcaagagaaggaaggaagtcagtacagagtgaggacccgaggagaaggaaggaagtcagtacagagtgagtatctgaggagaaggaaggaagtcagtacggagtgaggacccgaggagaaggaaggaagtcagtacagagcgagtatctgaggagaaggaaggaagtcagtacagagcgagtatctgaggagaaggaaggaagtcagtacagagtgaggacctgaggagaaggaagggagtcagtacagagcgagtatctgaggagaaggaaggaagtcagtacggagtgaagacccgaggagaaggaaggaagtcagtacagagcaagtatctgaggagaaggaagtcactatacagtgaggacccgaggagaaggaaggaagtcagtacagagtgagtatctgaggagaaggaaggaagtcagtacggagtgaagacccgaggagaaggaaggaagtcagtacagagcaagtatctgaggagaaggaagtcactatacagtgaggacccgaggagaaggaaggaagtcagtacagagtgagtatctgaggagaaggaagtcagtagagagtgagtatctgaggagaaggaaggaagtcagtacagagtgaagacccgagaagaaggaaggaagtcagtacagagtgagtatctgaagagaaggaaagaagtcagtagagagtatctgaggagaaggaaagaagtcagtacagagcaagtatctgaggagaagaaaggaagtcagtacagaccgaggacccaaggaggttctgatctgggccactagggcttcctcccactgggggcctcttgaagagctgggctgtttgtgcactgactcctgtctgtcgctggttgtggaaggttcctagagtcataactgcctgacccttccccctacatgggctgagcatgccccagcagccagagaaagcccctggcccacagttggaggggctggttataggaagccgttgcatagatgtaaaccaggagcctaaggaccaggcacaaaagcctctgtcacactgtccctgcagctggggtgagtctgcgagtagctaaaactgttacaggaaaggagtaccaatccagaccccaagagagggttcttggatctcacacaagaaagaattcagggcaagtccacagagtaaagtgaaagcaagtttattagaaaagtaaaggaataaaagaatggctagtccgcagacagagcagccctgagggtgggcccatttttatggttatttcttggtgatatgccaaacaaggggcggattattcatgcctcctatttttagaccatatagggtaacttcctgacgttgccatggcatttgtaaactgtcatggtgctggggggagtgtagcagtgaggacaaccagaggtcactctcgtggccattttggttttggtgggctttggctggcttctctactgcagcctgttttatcagcgaggtctttatgacctgtatctcgtgccaaccttctcatcctgtgacttagaatgcctgtctgggaatgccctttatgacctgtatctcgtgccaaccttctcatcctgtgacttagagtgcctgtctgggaatgcagcccagtagatctcagcctcattttacccagctcctatttaagatggagctgctccggtttacatgcttcctacaaaaccaggcttggctttattttcacctccacattcccagcgtgtctgctgactaaatggatgaatccatctttggagttttttttacccttggagggtaggaggaatttttcagccggtgggttcagcaggagctacagtgactgaatggcccctaaaaagtagcaaatgtctgagttgccatttgttgaaggttcatggaaatgccaagtccaagtggcaattagcatgagtctgtgggatttcccgcctgaaaagcaaatgaaggatttcttctattcttctgaattgtaaaccaagaataaaattctaagccccccaagcaactgaatggacccctcctgtcagccaagggtaccctaaatcaacctgaaacactagttcaagccacgatgggaatggatggtcagacaggcctcattacacctcgtccttttgcagttgaggcacagctgaccagcattaacattaaaacagagtcctaaagactgacaatagactttttatagcaataagataccaacatgacagcgggctctgaaagaaattgaagtattttaccctaaaatatatttctttgacatattgtgaaatagccctgataagaaacatgtattaggttggtgcaaaagtaattgcggtttttgccatttaaagtaatggtattaaaagtaattgtaatgccattaaaagtaatacaatctcttctctctaaagccagctacttggaggcttcatctgtgtaataagaacctcagtcaccacagccccttatcttaacccagacactcctttctattgattccgagactttaggtaaccacttaactctttcaaccaattgccaatcagaaaatctttgaatccacctatgtcctggaagcaccccactttgagttgtcccacctttttgaaccaaaccagtgtacatcttacatgtatcgattgatgtcttatgtctctctaacatgtataaaaccaagctatagtctgacccccttgggcacgtgttctcaggctctcctggggctttgtcatgggtcatggtcactcaaatctgaatgtgaccatggatcgtggtcactcacatcagaataaatctctccaaatacttgacaggggttgattgttttcatcaacgataatagaagatagtttcatttaaggaaagctttgaaagtcaacaaaactccaggcatttcttttaagggcgcccccgcccaccaccctttgtttttcccttcacagataaaaacagggagttccctcccaagcaacaaggctcttgaagtggagtggggatgaaggggcacttcgtctcaacagggcctcccttggagaatttaatgtctgctggatgctcccttgaaaagaaataaacctcatatgccaaatatttagccctccaaaactgataaaggaggaaagggaattaccatttcagcaggggataacttactttcagatttttttttttttaaagacagagtttcattcttgttgcctaggctggagtgcagtggtgcaatctcagcttactgcaatctctgcctcctgggttcaagagattctcctgcctcagcctccagagtagctaggattacaggcacccaccaacacacccagctaatttttgtatttttactagagatggggtttccacatgttggccaggctggtcttgaactcctgacctcaagtgatctgctcgccttggcctcccaaagtgctgggattataggcatgagccactacactctgcccagcccagacttttgaatgtcatttggtctaaccgccaattcactcattcaacaagtatttattgagcacctgctatgcatcaagtatagaatctaagcaccacagaacttacatcctagtggagaaaataacgatagtcaacacttacaaggtacttaccatacgtcatgcgctgttctaagttctagtttgtgtggttttcatcctttgcacatctttgaggaactttgtcttggaggaggaaagatccattcaacactacattaaatccatttggcatcctgaccaattcagcccagcacacacaggaaatgcgcttatgtgctgcccaagacatctctgtgactgcacaggtgtggggtgtcattgatggtgcagccagcatccaacccccaaccccatcctccttcccaagagtcctggacttgtttacgagcctcctgctcccctctgcatctcatgggcctcggagatgctgactgcgctccagctatggagctgctcaaatttaatcccatcttcctggactgtgattgagtcaagggtgaacaggatacccacctgagccaagggtgttctaggaggtgtctgctggatccttgcaagcaatgccttccttgcacttttgggagacattccagaaatgaccccgttactcctgctggacgggaacagaggtcaaacaggaagcaggcagactgtgggcagcagaccagaaagatggaaaacctctgggccctcaaggacatcttcaggtagctgaatgaaccaagcttgcagcccaccctgccttaatggtcgagatacacaagccagcacactacgttacagatggagcctctgtgcaatgtgggctctgtgagtgcaggcaaagctatcttgattcataattcatcccatttacggtgttgacagagggctttgagctgatgttttacagtttgttgtggttatcattgttcattttcttactctttgctttttaccctcagaccatggttgaaattttattttaccaagaatattcagaccactgttatagccatgaatgtcatataaggggaacactagattttaaaatagaggtgattttttaatgatcacaagtgggttggagtttgaaacataacatgattattaattgatgaattttaaaactcacaagtgcttcctcaggtgataaaccaagatgatttgtacctaagaccagactttctctggctctatgggcaactaagttacttaaaagtgtctctttttttctgggacctttttgttttggaatttttaaaaggcttaatttttttttagagcggtgtttaggtttacacaaaaatggaacagaaggagcacacccccacctctcccccagggtgacacagtgaccaggcttcttcccacctgtggccctcccatctacagcacaggcctctcacagtggcccaggggacagtctccagtccactcagtcatcttcagcatgcacctctgtggggtaagcttgattcaccaatatctctaaaaggatattttcttttcctccattttttttccagagacggggtcctgctgtgtcttccagagtggagtgcagtggcatgatcatagctcactgcagcctcgaattcctggactccagagatccttccaactcagcctccagagtaggtaagactacaggcacgagctaccaaaccaggctttttttttttttttttttttttttggtagaaacggggtggtcttatattgctcaggctggtttcgaactcccgggctcaggtgattggcctgcctcggcctcccaaagtgctgagattccaggtgagtgccaccacgcccagcccacattttacatttgatcattgtttgtgtatgtacaacatgaatgaatgacggttgcatggagagacagagagactgaggaaaatacagctcagccgtccaaatacattacctcccacattttttaaaatctgttaaacttcctctgaccccctcccaagtaccgtgatgtgatggagacaatgtcatcagtggcttactcctgagacccagaccaacagggaactcctcggagagattttgatgctccacattttaactacattcctatttcctaccaatttctcaatataattcccaatgtaatttatgtagattttttttttaaagaaaatatggccttggtgggaatgctggtcttgcagctgcttcctcccatgtattccacccatgcacacagccctagactcactccagctaggaaggaggctgcgttcaatataaatgcaaaacgctccagacattcatgattatctgtgctgtgcatgaataacgacagcagcttgcaagtgggcaggacttggcggcgaggccccatcacaaatccactgccacaccaacacgctccaacgaagtgcctgtgaaatctgccttcagtcactaatttcacactccagggacagagctgagaacagctccgagctcataattctcattttaataacagtttccttaaccttcagacactctttacagcactttttgacaccttttcaaaaattaaaatcctcgattcctttcaggttaaatctcaggtttgctttcgtttaatcatccctttaattttgtgacttcacaaatagcagagattttattttgtcttcagataccttgcaacactttctctagcttggttgcatttttaaaaatcaaaatgaatcgttcacatattctacattcattattctgtctcctgcagcgttctaaataatgtaggtattgtagatgcttctgtgatgagcacggaacgcatttgcaatgccctgctaaaatatgcttttcatctcctttcagatcataaaatgagttttcttctcttggtttctgaaggcctgagaaatactcttctcttctggaatgtattgcaagacacaggggagggtcctttgggacagaggataagatgagtctgattaactggaccaatgaaattgacagacgagcaggcatggctccaaagtgggaaacttacaagaattttggtgactggatttatgaaccccaaagaggtttgtacctggaattatggtttgattgtttctgtggtcagctgacttggttgtactttcccatcagtgactcagcccaggtgagacaactattcagatgcaagaatattatgatagtatggctcagtggctatatacaaattgcactggtttgttacttaaattggcttgttagaattcttttttttttttcgagacaaggtcttactctgttgcccaggccacagtacagtggcacaatcacacctcactgcagcctccacctcctgggctcaggcagtcctcccacctcagcctcctgagtagctgggatgacaggtgcataccaccatacccagctaatttttgtgttttttgtagagatgaggtcttgctatgttggcctatgctggtctcaaacccctgagctcaagcgaacctcccatcttggctttccaaagtgctgggattacaggcatgagccaccacacctggccagaattcttttaataagctatggttcacatggttgtacattttaaaatgagatttgacatcaagaaaataataaattaatcctaattttgagttcctagtgcaagtctctccagttctcagagactctaggggaaaatgcattccttgcttcctctagctgcaggtggccgttggcattccttggcttgtggccacatcccttcaatctctacctttgtggtcacattgcctcctcctcttgtgaccagctgtctgatctccctctgtctttctcttgtaaggacatgtgtgctagcacttacagcctgcctggatagttcagaatcaactccccaagattcttaacttaatcacactatttgccacataaggtaatggtcactcttttgccatacaaggtgatattttaggctccaagcattaggatgtggacatgtctttttaggggctactgctgaagtcactgcaaggtcctaactcttttcctcttttgagatggtgaaaaaggatttcctttgtagagggggacaatctggggtgttatgttagtttcctatttgctgtcataataaattactgcagggacaggcacagtggttcacgcctataatcccaggacattgggaggttgaggtggatgaatcacctgaggtcaggagtttgagaccagcctggccaacatggcgaaaccccgtctctactaaaaatacaaaagtagccagccatggtggcacgtacctgtaatcccagcaactcgggaggctgaggcaggagaattgcttgaacctgggtggcggaggttgcagtgaacagagatcctgccactgcactccagcctgggcgacagagggagaccctatctcaaaaaaaaattaattaattaattaattaatttaaaaattaccacaaattcagcagccctgttttttcttggcatattcctctcatcacgttctagctttctgtctatccaagcagtaatgatcccaacaattcttctttcctatcctattggattctcctcccattccacatttccacacctctgctaaagcacattccttgccactctgctgactattgcaaaccccaacccaaccctgactctgtctcctctgccaagcccccatgaggtttgctcttctgctgtggagttcactaaaacaacagcattttccagcatgttccttcccttgatcaaaagccttccatgcctctcctcaccccagcaatctggcccaaagcagaccctgagaatacacaagatgatttccaggataacccagatgaacatctttttaaaggcccatgtttattttatcagtttcagggtaaagagtagtcggaaaatgaaactcatgtcttcacaaatatttatgcttaggatgcagctgtaggtgaagtaaagaaaatggaatccattcaaataaatataataagtaaattaatatccaaatggaaggcaggtagggacaaatgatggtggtagtaaacggattattaaagtctgaaaagtcctgacccacaggataaattctaaattagtttggaaaaaaaagaatattgactctctgagccagtcttgctcccagcatgactactatctaaaacatccatatttttgccagacgttttctcagcatcccctgaactaaccacctcatgctcatgggtttctcccacctgccatgtcccccacccctcatcttgctcgtgtgaatcctttgagacccagctcatgctttaccccctccaagaagccttccctgcatgccagctcctctgagatcttttcctctcctggctgcctatggtgcctatcgcttgaatgtctcctttgtgctttctccacaacccatctggtgctttctccctgagtgatgtccctaaaatacagacactgcctctcaccagagaccatcagagggcattgtttttagaaggcttgggattttagttgcaaagataccccctacccatcctaaaggtgcaaattctcttttgggcaaaaagccccttaagaacagcaggtcactgaaatccaactcaaataggcatacacaaaaaattcatatgtggtttgcataattaatagtttggtggccaggtgtggtggctcacgcctataatcccagcactttgggaggccaagctgggcaaagttcgagaccagcctggccaacaatggtgaaaccccatctctactaaaaatacaaaaattagcttggcacggtggcatgtgtctgtaatcccagctgcttgagaggctgaggcaggagaattgcttgaacccggaaggtggaggttgcagtgagccaagattgtgccactgcactcccgcctgggtgacagagcaagactccatcttggaaaaaaaaatagtttggggtgaggggtttcaggcatggctggatccagtagctcaaatcctgtcttcaaggctccattacttgcactgttttctgcattctacacacacacacaggcaagtccctctctgtttgctggtccagttttacatcctgacagtaacagatcccaggttatttttcccactagcttttattgacctgaattggatcatgtgatggttagtgagtcactctggccaaggagaagtggggagtagaatatactgattggccagacctggatcattggatcatgagcctatatctggaactggagaggagtagggccaattcttccatatagagtgaaggggcaataggagaggtcgccaaaaataaaatcaggaccgggcttccaggagaagaaggaacagatgctctgcagacagaagcgacagctgaccccatgacattctgtgaatgagacaggtaggaaacttgtgtattcaacacactgtagcaggagtccccaacccctgggccacgggccagtaccagtccatggcctgttaggaacagggctacacagcaggaggtgagtggcgggccagtgagcattaccacctgacctctgcctcctgtcagatcagcggcggcattaaatgctcataggaacgtgaaccctattgtgaattgcgcaagcgagggatctaggttgtgtcctccttagaagaacctaatgcctgatgatctgaggtggaacagtttcatcctgaaactatcccccctactccagtccatggaaaaattgtcttccatgaaactggtccttggtgccaaaaaagttgaggaccgctgtactatgggaaagaagacaatgacattagaggcagggaaaaaatacgattatgaggaagtcggtggggctggtatttgtgggtatcttgttattgttgtttgattgagaaaagaattgtaaagatgcgtaacacgtcaatgctttgaaaaagaggaaagtgttttgtgaggtgtaatgtattatgcaaacaaaaggcaacgtggaaattaccactgaagaccgaagatagtaaatccttattccctcgggatctctggtttttatagagagattaggttttgtttacctgttttaaatattaaactttcagttttgtgccttagttctttaagagaaagaatgtatgtctttatataatgtggatcatcagctccatttgatctaaagctaaagctctctctaaatcttttatctgactcagggctttgctgatgtgtctgcacttagcctctgttaagtaaagaacggtgccacagacggaaactggctacagagaacaggctccttggggtgtccatgagaaaattctcctatcccctgataataagagtggatcaaaaaaggagagaaaggattaagaagcaaaaacctcattgtggctgcaggaagcaaatatcactattcccctctctttctactcccctctctttctgtcccagtcaacagtttgtgaaatttctccatgttcccaccacactccccactccatataccccaggaacgctggcctcagttctggtccttcgaagattctggtcctagtagattgaaattccttgaaacagatgaacctcatctaggttgttcactgctgtttgcttataacctagtctcttagtccatttaggctgttataacagaataccataaaccggtaccttatacacaacaggaattcatttcccacagttctggaggctgagaaggccaagatcaaggcagtatcagatttggtgtctggtgagggcctgctttctgattcatagatggcaccttcttcctgtgtcctcaaacgacagaaggggcaaggcaattttccagggcctcttttataagagcactaatcccattcttgagggctctgccctcttgatgtaatcacctcccaaaggccccacctgtaatatcctcacattgctaattaggtttcaacacatgagttttgcaggaacacaaacattcagaccacaaacattcagacaaacattcagctacctagcccggtagctggtgtgaaagaggcactcaatagatatttgttgaatgaatgtattccctcatcaatgaaatgtggtatcactcatctttttagggatgtgttgctttgttccatttcttttgtgtgtatctgatctctagtgaaatgatgaggttgagggggtcaaccactagaataaccccagagcttctcagcctcagcactactgacattttttatccagataattctttgctgctgggagttggcttttacattgcaggatatttactagcatccttggactttatccactggatgccagtagcaggtatggatgcatgtgcatgcacacacacacacacacacacacacacacacacacacagttgttacaaccaaaactgtctgtaaatattgctgatattccctaggttctacaattggcgttggtagagagtccttgtactaaactagcatcataataagcaccaaatgagtgctcaatgcagtcttgttggatgagaaagtgcacttcagttttacctgcctcgaggattttagaccatcactctcctaaaatcttgcacctttgctaatgcttcagttcactcctcaagcacctgatgagcacttgtgaaatacaggccctctgttctgggcactgaagatccagaacagcatgatccagtcctggactcaaagaactcatgtctatcaggggaaatgaacaaaaaatatcaggctgtgacaggtcctaccatgaaggccacgatggaggttagggcagcaccaaggaagggggcggtcaggctggaagggcaggggcttcataaagcagaagctctgttttgttccagccacactccagaacaaagagcatgtcctggcccacaggagccactcaagaaatattggctactgaaagacctccaggaggagcagggattgaaacaccaaaagaaactgataatcttggcggctctgaagatattgcatcgggggcctgtttttatcctaaagagagagatgagtaagttggctccatcagggaatctggaagtaaatcagggcccagactggttttgggggaaaccaatggtgaaccctaggtgagaaaagatactccatgtcactacaaacccaaaaaatgtaagtgaaagcaacagtaaattcctttggaaatgttggaaatgaagaaagtgtgtccactttggttggattctggtactctggaagtccgtataaatccctaggcaagctcaatacataaatgttaataataatagcagctaacactaaaatattaatttgttcagtacattgttttgacaattacttatttcccatgactcatttaatctccacagaaaatctgttgggtagctattatcatcatctatttcttactgatgagaaaactgattatcagagaattagcttttcctaaatcactcacctagtaaattcaagagccagaatttgaacctaggcagtctgcaacaaaatctgtgctcttaaccacagttataaagggtctgaaaataccaaaaggactttaacatcaaagtcataaccattttaaagaatatagaagagttgggcatggtggtacatgcctataatcccggctactcaggaggccaaggtgggaggattgcttgagccccagagtttgagatcagtctggcaacacagcaagactctgtctcaaataataataataataataatttagaggaaaagacagaataaatataaagatggagaatttcaacaaaaaaattaagaactctgaaatggaaccaaaaggaaattctagaactaaaaaattcaatatctgaaattagaatctcttgggtgaacataatagtagaccagacttaaaagaagaatcagtaaatccaaagtcaagttgataataattatctaactgaagtggaaaaagaaagaagtgtagagcaacatcaaacagtcaaacatatgtataattggagattcagaaggaaagaaaagaggcaatagagaataaacaatattgacagttaaaatggctgaaatttccccagaattgattaaagacattaagccacagattcaagaagctctatggcctggcatggtggttcacacctgtaatcccagcatttttgaaggctgaggtgggtggatcacttgaggtcgggagttcgagaccagcttggccaacatggcaaacccccatctctacaaaaaataaaaaattaaccaagggtggtggtgcatgcctgtaagcccagctactcaggaagctgaagcaggagaatcacttgaacctgggaggcagaggctgcagcaaaccgagattgtaccactgcactccagcctggggatgaagcaagaccttgtctaaaacaaaacaattaaaaaaaaaaaaaacaagaagctctgtgaatgctgagtaggagaaatacaaaggaagttacatttaggtacattacaatcaaacttctaaaaatcaaagatacggagaaaatctttaagacagctaaagaaaatatatcctatacatcagaacaatcagaatgatgggtgacttctctcagaaatcatggaaatcataaggataaaaattgtattttcaaagtaaaactgtgtctgtcccaaagggttaaagaagccaatgactaaattcttgggcttacaggataacagatttttaaaacaaacaaacaaaatatctgatttttaaaacagatttaaaaaaaacaaaaactgaaactgtgctcttaaagagtaagtaacaagtaactaacaaaaattcttgactggatgcagtggatcatgcctgtaatcccagcacttcaggaggctgaggaaggaaggtcacttgaggctaggagttcgagaccagcctagccaacatagcaaaaccctatctctaccaaataatacaaaaattagccaggcgtggtggcacccacctataaacccagctactcaggaggctgaggcagaagaatcgtttgaacccaggaggcagaggttgcagtgagcagagatcacgccactacattccagccaggacaacagggtgtgagactctgtctcaaaaaaaaagaaaaagaaaattgagttttcaagataacagataagaagaaaaaacaacttcctgaaatgctgaaactccctccacttataaaattttaaaaccggctaacatcagttagaaccaagatggccagctagagtttacacagatgcgcttgctgatgtcacagcctaaatttccaccatgtttcacactaactcttctccaaatttacacgtgctacccgtgagttaacataaaagaaaactacacacgcccaaggattttccagacctcccgttttctttaccaacacttactaatcttgaaatccacccactgtatttcctaatgaaaatactgccttgaggttggcacaagaagacagatttgaatccgactcctatcttcttgggagttgactttcaatataaaacctctattttctcaaaaacctgtgacataatattgacttctaacgcattacgcaacaagctccttttactaaagtaacaaaagtgctaggggattaataaaaacatactgccaacttggatttctatatccggtataaataatcttcaaaaatgaagttgaggccaggcacagcggttcatgcctataatcccagcagtttgggaggctgaggtgggtggatcacctgaggtcaggagtttgagaccagactaaccaacatggagaaaccccgtctctactaaaaaatacaaaattagctgggcatggtggcacatacctgtaatcccagctacttgggaggctgaggcaggagaatcacttgaatccaggaggcggaggttgcagtgagccgagatcgcgccattgcactccagcctgggcaacgagagcaacactccgtctcaaaaaataaaaaataaattcaaaaaaagaaaaaaaaagaagttgaaataaagatatttttcaaacaaataaaatctgagagaatttgataccaacagatctaccctattaagaaattataaagaaagttcttcagacttaggcaaaatgatctcagacgaaagcacacatccacagtccacagaaggaatgaagaacagcaagaggataactatgtggctgaatagaaaacactacttgcattaaaaagcactgatctaaagtaacaagaacgacaatgtattgtaagttttattacatatgtagaggaaaacatatgacaataatagaacagacaagagtggaaaatggaattatactgtcgtaaagttcttattaggcacatgaataagtatggtactaattgaagattaattgcaacaaattaggaacgtatagatgcaaagacaacagaggaaatacaatggagtaatgaaaaacacttgattaatcagagacagaaaaggaagaccaaaagaacaaagattaggtgagatgaactaaatccttcacttaaaaggcagagatcagcacacaagattaaaataagaaaaccaatgaagacctaaacccaactacaagctgtttacaagaaacagacttgaaacagaagtgaaaaagaacaaacagtccatgaacccaacaacatggggaatctcaaagcataggtgggcaaaagagtgcctacttatgatgaaatttatatgaagctcaagaatgaacaaaaaattaacctacaatcatcaagtattagggaagtcggagtgtagttatcttgggggtattatttactgcaaaaggccacaaggggatttttttagtagcaaaggaaatcttctgaattacaaagatgagtatatattttaaaattcagcaagctgtgcatttaagatttgtgcattttgctctgtgtagattgtacttcagtgagtgtgtgtgtctgtgtgtgtctgtacgttctcacggctttccctgcagatggggtttaccaggacccagtggttgacatggaattggtgagtggatagtttactgaggtgtctccagcatagcatgtgtgaggatgctgaggaggcaggggagggaggagggagaggcggcagttacaactaaggcctcagcagatccaccggacctggcagtgggatggcctttcagacttatgcatggttgaggacaggggctgagtctttgcactcctgagtcacccagttgtgggatgctggctgcctctagggagaggtcgcagcctaggtcatggcagcttcctttataggttggcaactcctggcgagggacactgctgtgagctgtctgcagccaacactcctggctcctggggcaatgggcaccaagtcccaaagggaagatcaggtggcaaccacaacatcccctacaacctccctcatccaagccaccagcctcattcacctggatgaatgcaacaagccccactggtctccaggtactcactctgtcttcattaggattggttcaccatactgatgccaggggctgtttaagagagcaagtcacaagcatgacaccctgctccattccttcagtgtctccccatcctgtctggatggaattttaatttttttaaatctttattattattattatttgagacagaatttcgctcttttgcccaggctggagtggcatgttctcggctcacagcaacctccacctcctgggttcaagcgattcttctgcctcagcctccggagtagctgggactacaggcgtgcaccaccacgcccagctaatttttgtacttttagtagagatggggtttcaccacattggccaggctggtctcgaactcctgacctcaggtgatcctcccgcctcagcctcccaaagtgctgggattacaggtgtgagccactgtgcccagcctggaatggaattctttactctggctatgaagatccagctggctcactccattcagccacaccccagctcagggggctttgtgcagaacagggtgaccaagtggccctggtttgcctgggacttcctggctttggcactgaaaggaggagccaatccacctgccctcaaagcccagcccatggtgggaagagggcagcagggtctgagctttgcattccctcattcctgggagatggttcccagggagctcagagccccagaactgtgcacagggaggggacacattttctgtggctgggcagtgattagaacttagaaaggcatgctgaggtgtgactgcagccgaaggagcgtggctccctccctccacggtagttagagccacagtgcattctatccaccagggacgccaggagcttgaatctgtggggatgtgcctctcctggagccgaatctggctggcatatcagggccaggcagttctccaaaacatgcctaccagttgtcccagggccagcctccctggatgtaagccttactgattctgatatttgcaaagaaataaaataggagtgggaggagatgaaacaaactctcctgtgacctcttctattctagagttgactttgacacttcgagtcgcactcagagcatctcaattgtgggtgcctttggcatttcgtgcagggcaattttcattgtgtggaactgtctgagatactgcagaacatttcatgtccctggctcatgctcaatagaggtcagtagatcacttctttccctaaccactgtgacagcataaaacaccctcaccccttcccactcacatgggtttgcatgcaaatctgacacttaaaaaatgcctttaaaactaagtgggggaaggaggagacatgctcccaacagcattactagctgggcagggctctccacagggtgccaacccatttagttctaagctctcacacctgtcaaagaatctcattaaatcttcactatttctgcaaagagaagggaaggcattcagtatcctaaactgagacagttataacaaaatgtgagaaaaggagagagggattcatggtacccagccagcagacgttcttggagcacttactccatgccaggcactatgcctgatgggtaatacaagaagaataaagggcgctgccctggactcagggagctcactcctcctctctgggcaacagagaaaagtcacccactgcagcaaaagccatgagaatatgctcagtgataaggcagtggcgttaaatctgcaggcagtgggctatctgtgggtccttaaatctatttagtgcatcttgaacagtatttttaagctgggataagtggaataggaaggagtggagtggagcatgatggtatgggatgggatggatgggatgggatggatggatggatggggtgggatgggatgggatgggatgggatggatggatgggatggatggatgggatgggatggggtgggatgggattggatggggtgggatgcgatgggatgagatgagatggatggcatgggatgggtgggaggggatgggatattatcagatggcaaaagtaagaagtgttcatattttgtcttcaaaatataaatatgagtgcataatggcttgtgatgcaaaatacatttcttactaaagatcatggacaaagcacttaaaaccacacagtgtaagggactacagtcccttaggagctgcttttgcaataatttacctgaaaactggtatgaaaatgagtcatgaattggacacttgatgtcagattttttgaataattttagttataaagcaacctcacacaccacaaacgcatttttatatctgattatttagatgattcccccaacaaccctgggaggtggcaagataggatcatgcttctccttgcaaagctgagacgatggggacttggcaaggctgagagactctctggaggttgacagctgagaggtcagagcaccagacctgggggtcccacagcccagctcccagtgtggagggtcctgctgtgcccactgccaccaaaaacacagcttcgcccagcatcatgcagtatctgccacacagcgtctgtctgccacatggcatctgccacctgaactatctccaggcacctctgcagttacagcaacaggtaggttgagggcattcaatttgttttttgtttttgttttcgtttttgtttttttgagacggagtctcactgtcacccaggctggagtacagtggcgcaatctcagctcactgcaggctccgtcccccagggttcatgccattctcctgcctcagcctcccaagtagctgggactacaggcgcccgccacctcgcccggctaatttttttgtatttttagtagagacagggtttcaccgtgttagccaggatggtctcgatctcctgacctcatgatccgcccacctcggcctcccaaagtgctgggattacaggtgtgagccaccgcgcccggcctcaattgggtttttgacaaaagactccctaccaagatttcacgggcacaaactctccacacttctatcctgagagaaaaccttcccactgtaacttctgactctcggttgttaatgtgtttggctgtcagttcctaaggagccatgtccatcgagcaggttggatggcgccaccttggcagttccttccagcaccctccaggggcagtgcgtcctgctcatcctgcaggtgttttttgagcaatgctcagtgccaggcacagttccaggtgctagggatgcagctgggccccagtccctgccccatggacctgacactcctgacactgcaatctggctgggggaagcaactcttccaagggcttttattccaacacagcccatggcccaccgcccctcagactaaaagagaaaaaaaagtgaaatgtcaaggtttctccagaaggagagcacagaaggaaacacgcagattgaaacgctgtcctggctggggatcggcaaacatcccctccacccttgtctatgttcagcgctccaccccaaccacaggagtgtgtgaaagagggtcttttccatctcagtgtctgtctgaggggcacagcgccctggtttgctgatttgggggtgtcggcatgaagtggactcagtggagactgagccaagtcttgagcacagatggcttcactcttgctgggaggtcagaagtttccgtgatgacctgtgtcacgtgtgttcattacaccacgaaatccatgaccttccagcaagaactgaggcttagacaggctgagaaacttgttcaaagtcacaaaccagggtccctggtgggcttgggatttgaacccagagtgactggcctcagggccctgacacataaccatgacaatagtccccagagtccttcctcttcttagagcctgtattagtccattttcacactgctgataaagacatacctgagactaatttataaagaaaaggaggtttaatgaactcacagttccacatggctgggggggggcctcacaatcatggcagaggatgaaaggcatgtcttacatggtggcagacaagagagaatgagagcagcaaaaggggaaagcccttataaaaccatcagatcttgtgatggttttatcttattcactaccacaagaaccacccccatgattcaattatctcccacctggtccctcccacaatttatgggaattacgggagctacaattcaagataagatttgagtggggacacagccaaaccatatcagagcctgtggttcatggacccaacccaagcatctctcccacagccccacgttacttaggattaagtgtaaaggggagacaagccagacatttgccatcctcagtccaaggaagcagagcaagcctcagtttttctggaatatcatttattgtcaggacagaacacagatgtttccatgtctgagcagtcatttccctgctccttctgaaaagaagccatttaatcatcagagatgccctagaggtccagtgtaattgtgggttggtttaaaagcggctgctctgacctccaaggacatctgctaacatggtgtgcagtcactcacactccacgctgctgtgtgcttaaacgctgcatgaggatttattcatttgttcctcacaatagttccataatcatccccattcataaacgcagaaacaggcccagaaaggctaattaagttaatgtgtcagtgatagagctgagatttcaacccaggaagcctggtgctgatggggtccacacacttcactacaccatgtggcccttgaaatgtgtcccaggttccaactgcaaggacatctttatgggggcagggcttgaagtcagtttttccttgggtcctgcagtgtccatcaggaagggtgaggttggctgtgattcagatttcagcttagctgctgtctttgctggaagtcaccccccaagacctgtctcaagatctcctccacctcctccttcaggactcaggtcaaatgtcctcccctcatttactgagtccccaccggtcgtcgctccaccacttcagcctggttaagtttctttctagcacatttcactgtccaaagtcatcttgagtgtcgctttgacttcttgcttgttgcgtgtctttgactgcgagtgtcaggtccatgggggcaggaactggggcacagctgcatctgcatccctagtacctggaaccatgcctggcacaagcattgttcaacaaacacctgcaggatgagcgggaggcgctgcccctggaagatgctggaagaaaccgccaaggcggccccatccaacctgtgcactgaacacaggaagccacaggagcagggggcatgagatggcccctgaggctgtgctcatgaccacccggtggcactgccacacaggcacgccaaccacttacctgttacgtgaccttgagcaagttttttaacctgtctaggcctgtttcctcatctgtagaatgacgatagtcatcatagagtaactgtaaggaatacatttcctgagtccatccatccacatattcatgtaacatagcatcacgtgaatgtgagtcatgatcgttcaacttattgtcatcgcccaggacaaggacggcctgaaattcttgagactggtaagatttgcaggcagaacctcaaaagtggtggagggagacccatccacactcatcacagtcatcactggggccgggagataaaccactgagacctcttcagccttgatctgccagccacagctaagaagggagccatgctcctgtgttctggtcccaagggactttgttgggatcctccccatcgctatttgattacacaagtgacagaccccagtaactgccaccttccaggcctctagcctcgtccacatttcccttcattgtgagctcctttgctcctgtcttgctggattcttcatttcaaacatcccagtgcaaggtcctctggaaaccttgaactgtgtctgttgcctgcattccttagaaagcaacccagcaccggcgagatcttcacgttctcactgttcagaagcacttcaggggaggggtgccgccggtgactcctgtctcaattcttccccaaaggcctggagatgtaggagagctctggaaattacacaaggattccacaacagcagcacaatagcccgtgattcgaccaagatgtcaaaatcagcatgtagagggtgcgattgaaagtgtggttggcaccagaacatcacttttaattgagcctgtgcctacatttttgcatgcaacatggaaattaacagcagagtgataaaacttcgagaaaaactaatcacccttgctgtctgctcctgcccgtcccttgtttaacctgtactctcctgcccccgactccccttcccagaagggtcctggaggtttctatcacaggccaggctgctacattcacaacacatcccagctcagcccagcccctccagggctctgagagagttgtctcccaggcccatctgctcagacataaccccatgaaaagagctcagtgtggcagccagggctgtgttgactgcagaaaggacagaagatgatggggtgagggtctgggcagtcgggggttcgtgcattgtgtgggtctcacacgtggcttccctccaacaagccctctgcattcctggtcagacgtggggaggaagggagggaggggagaaagtgaggcagcagagctggggaggggcccaggttgcagggacttgtgtgcagggcacgagatgtcactgggggcttcctacatgagacacagtgagccgtcaggattcagggggcatgttctgagagaagagcccaggggaatacgggaaagaggcaacatgagaatccatcagccaccaccccagtccttccctcctctgcccaggaccagagctggggcctgggagacagggcgggctttctgcaggagggacacccaccctgagaggaactcaggctgtcatagctgcacagacattgcaagccaggagcagtggtcacaccagtggggcaggggcatcgggagggggtggaaacagcaggtcacccacgggctgtaagcatctatctttgaggtgaccgaggggacccaaagcaagtgacagagatgcatgctcctcagcaagcctgagaggtctctggggacagtgggtctgggggcaggaagcagcagggggctcttacaggtgccgcatcgagatctggccacttctaccatgagcagcaggcactccctggggattccatgtcctcagcctctggttgaagggcttcccagcctctccctttctctgttttgggggatttgggcgggtactggcatctccatctgtgcactcctgacccctgagtgacgtaaagtaggccctccccttagacacatttcagtcctgtcccacatagcccgggctcagggatgtggccctatcccggtgtctcgggaggaaatggggcttgaatttctcatgagacaccagacacccggtgtctcacgtgctgtgtaagaggatgcttggcgctgcgacctccttgcaataaccatcatctaatagggccaggagaagtggaggagaaggtgccattaacggggtagccagttgttcagaagcagccccttcctgcatgggagcacccctcagaggtgtccaggcagctccaaccagcagataatgggtgtccggaatgtgcagagccagcccagatctcagcagggataagtgatttgcaagaaagaacttgttggattgaggagctgccatgagtcccagcggcctggcattttctcctggaggctgtttttagagccagactgggggcggggctcccccttggcctctgtgggcccctgcagtctgcaccaggcttggagtcaccaggctgatttcacggacatttacggagcctgcaggagaccatagcttagcatgtcccctgctaattaaaggacagtggccagttgttctcggtcagagtttacaaaggatgattgctttgtaatctggagtgtcccagggagcagatgggagagcgtcagatgccaaaacctgatgcctgacacctggcattctttggaagtgacccttcgaggagcatcagccattgtgggagagacgggtatcagggggccgccctcctggctctcaggggctcagctccgcccacacagggcaggaggatgatgcctgaaactatgcctgtcctcacacaagagagattggggtctttgcatggtgggatgtgaatgcctgggggtcaggggacccatgtagggctggaagagggggtcttggcctcaggaccagccctgcttcagccagtgtagccatgtgtggaagtaccgcccagcattgcttgacttccctggcagccaggacagcctgggtctgagtccctgctacagataaaaagaaccaaatccaaccatttgtctccagccattctcagcctctgcctctctccccagcccctccacccctgtgttcaaggaaggcagagcccagaacctgttgtgtgaggccttgggctttccacggcctgatgagtgccagtctctggggagccctttgggggacacattcagattctcacaattatctcatacccagactgcaatctgccatccaccagcaatttcaggactgcgggggagggttcatcaaatttgcaagtgtgtttgtttctctttttacccaacattctatctgtgagatgctttataattcaccagatgtaatatacctttgggattaatattccatgttaaatcctttgaaagcaatcaacaactgtaatccaattactattggctgtatctttcacgctattttgccccaaacctcaagccaagctcactatacacatacacacaaacacacacacacacacacaccccacagcagatgccaattttgtgcctcgttgcctcacataacatgggagcattgagtagtgaacagctgatctgcatgaattaacgtgggaggtcgtgtgggccctgaagctttcacacttacaaaccggtgtcaggatgggttgtcatagagatcaggtgggaggacactagggttccccccaagactctgggcctcctctgatgagcaggtcacatggggatctggggggaggcacaggcacgaactgcatattaaatacacctgactcactgtgtctgtgagtgtgtgggcgtgtgtgggtgtgggagagtgcatataggagtgagcatgtgtgtgagtgtacatgtaagtgtctgtatgactgtgtgtagtatgtgtgtgcaagagtatatgtatgagggtgtctgcgtgtgtcagtgtgtgtgcaagagtgtgtcagtataagagcatatgtatgtatgcaggggcatgtgtgtatatgtaagcgtatatctgtgtgtgagcgtgtgtatgcatgagtgtgtgggcatgtgtatgagtgtatgtatgagtgtgtctatgtgtgtgagcatgtgtctatgagtgtgtctgtgtatgtatgagtatgcatatttgcatgggcatgtgtacatatgcatgtgcatgtgtgtgagtgtgtacacatatgagaatgcctgtgtgagtgcatgtatgcatgtgtgtggtgtgcatgggggcatgtgtatgtatgtgtgtgcctatgtgtaaggatgttcgtttgcatgcacatgtgtccaggtcctacatgggatgaaaactgaatggctctaaagatctgctggacacatttcagatcctaacagagctcttaagctccaaggggtcactgaatggacggacaatgagggtttctgagtctaggcagcgctgactcagcaatgcaggaaggcagctcttggagcttcacaaataacccccccaccccctttctctccctcacagtcacagacccctccccacgtcccttcctctccctctctctgtttgccttccatgcgtctccccttcctggtctcatttctcgcacattcatcacctcttcgtcctgcggtgtaattcccctccactcctcagcgtggactgtgggatgagacagccgcagccttgcaacctggccgcggaaaatgcttgacactggtttgtacccatttctcagtcttgggagcccaccccaactcagggaaaatattcacgtgcatacatacatttggacataatacatgaatcatatacaaggaatgttcaaacaggccgcaatcaagccctccatccagtgtttagttttggtttcccccaaagcagaccctgaggcaagctttcaagttcaagtagtttatctgggaggtcatcacaagcaataccagttggggtgcggggcagggaggtcagcaaggtggaagccaatatggcattctgccttctctgggaaatggcccaggcatggtctgcaagcccatagagcctggccttgcagtgccagccaggagatgggcctggggcaggggcggccatgcctaccacaagcaagttaccaatgtggtaaacaaagcacagcctttcagggccctacagcatagaacacgtacctcagaggtatcgatctaagggccacaggggctggggcccacccccaactccatcaggcgctgctatgggatcccctggaagcattaatttcccagcacctccgtctctcccatgcagccccgaccctggcagcaggagacacaggtgctggcagcccaagttggggggcaggagcacagcaggggaagggccaggggacagggggacctcgacagggtctgccacatgtctcagctcaactgagggagaccccctctctggggaaacctcgctgttgctcacttcctgccttggacccgtccccacccaccagcaactctggactttcccacaaatggctcgggctccatttcccaggggtaagtctgggttcctcagcccttgagcacagatctatgccagcactctccttgcacgagggcacatcagggatcaagagaaaaggctccttcccttggcaaggcagacataacagtagggcaggcaggcgagaggcagagaaatccaaaatcacgaaggtaacgtcagatggtgaccagctatgaacagggtagagcaggcacgtgggataaacagagtgacagtggacgccagagcaggttgaccagggaggaaatgaggggagaggcccggggagctgtccacgtaccagtcgtggtaaaatgtcaccggacctctaatctgccatcttgctctcttcgcctttgtttttcaggctttacaatctcatccccaaaataacagagcacagacctgcccggcccccaggtgatttttcttggtgttaccctaaggccgtgagacagagattctcttaacgtttttagtgcggccccttgcatgaaacccgttgcaaactgccacccagcacacacacgcacatccatttacacagaaatgcagcatgtttccccaaacggcactcacccccgctgcacacaatgcgctgatgtctcctgacctagtctgttctggtctattgcagattttcaatgccgggctcgacactctaaattgatttcaagacccgctaatgcgtcacagcctgcgatttgataaactccacgctaagacacatcccgttgtgaggtgttcgacccagaggccatttatcctgcagtgagccgggtggggggggcaggattcaccctgaggcgcgtctcctccttctcagtcgggctgggaggagggggctctgtgccatgggacccgcagaggtcccggtctcagagttcgtgccctgtagctgctgtgtgtccagcagctggcagggcgggtgggttgggggtgggggtgtcactcccacagacacacagcacagggcagaaccctggctggaagccgctcagccctgggacctcccgagcccacctgggatcaggccctggggaacagctatgggggacagggactcccagtgcacagaacaggccatgagctggacaagctgctccttctcataatgtcagacccttctgctgacccacctaggaccgggagcttgcagacaatcctgggcccagagaagcaggcagatgtggctgttggtagcactaatatgggttgtgaatatcacctggtagttattattactttacttactttaccccagccacttgatcctgcacacatcccctcacttcatgctctggatgaagttggggacccctggatgagaccacaccatgggcctgaaagtcacgggaggaattatattagatgtggtggtcttggagggctgctaggaggaggagaaatgtgtagagagctggatggactgagtgatgagcaatacacatttctagaggaagagagtgcaggcagagaaaacagcaagtgcagagtccctgcgctgggaaaggtcagtgtgaccacagtggagtgacagagagggaggagaggaggtctgagagctacctgaggcccagatcatgtggggctctccaggccacagccaggagtgtggatctgcttctgagtgagggaagaagccattggaaggttcagggcagtgagccgagatgtgagtgacatgatctgatttgcatctgcctccgtcatgactttcgaaatagctgcatctcatctatattctgatctagtcaaaatttatctctaaatcagttacatttttagaattttttaaaggaactttgatattccactactgcaaatgaaaaatcagtatcacttccatgaatagaagagtatccatgaaaacacacaacaaaaacagagccgtgttattactttctagccagaggctgctaaagacgatgcacctgaaacctgtgctccctttgtaaccacccaaggggttcaccttgcccactgcctagactgagccgacttatcaagacaggggaaattgcaatggagaaagtaacccatgcagagccggctgtgcgggagactggagctttattgttactcaaatcagtctccctgagcattcggggatcagagttcttaaagataatttggtaagtaggcgctcagaaagtggggagagctgattggtcaggttggagatggaatcatgggggtagaagtgaggttttcatgctgtcttctgttcctgggtgggacggcggaactggttgaggcagatgaccggtctgggtggtgtcagctgatccatcaagtgcaggggctgcaaaatatctcaagcgctgatcttaggttttacaacagtgatgttattcccaggagcaatttggggaggttcagactcttgcagccagaggctgtaatttgttagtcctgcaaaggcagacggctccccaggcaagaaaaggctataaccaattttgtttgagtcaaatcatgaactgaattctttctcaaagttagtttggcctgtgcccagcaaggaacaagggcagtttaaaggttagaagcaagatagagtcagttaggtgtgatgtctttgactgtcataatttcctcagttataatttgtgtgaaggcagtttcacctttgtctctctcaagcagtagagaggtattgaagtcacatgagcattgaactgaaactatctccatgactatctcagagagactgaaagacactgggcaagggaatacatttcacactgtgggattccacagcgtttcatgctggttcaggaaccacccaaaatcatctcacatattcacatatcattttttttttttttttgagacggtgtttcgctctttcacccaggctggagtacagtggcgcgatctcggctcactgcaacctccatctcccgggttcaagcgatcctcctgcctcagcctcctgggtagctggtgttatagatgtccgccaccatgcccaactaatttttgtatttttagtagagacggagttttgccacgttggccaggctggtcttgaactcctaacctcaggtgatccacctgcctcagactcccagagcgctaggattacagctgagagccacaacgcctggcctatctcacgtatctttggtgggcacccctccactctttggggaaacaccattttgaaatacagtatattttcaatttgatatttaaggtcctcaagggaacaaaatcataagatttttatcttttcctcctcaaacacatggtggtaaatgcttcatagatattcatctctaccctttaccttcagaagccatggggatgttgctttggttttggttttgggttttgctggagcgtttgggtgtttatcttttgcatagttgtttaggagataaccatgggctacaggagaaggagagacgtttttgcactacttttctttcccctgaccatcctgatgggcataattgctactgcaccagcctcatcctttctcccgggtccactcctgccctttccagcctgttgtccatgtggcagccagagagctcattgtggagtgtgaaggtcacagtgccccctgctcagacatctatgatgctcatgacattgcacgaaaccctccttcctcatcatggcactcaagactgctccctgccagcctctctgtcctgctccaacctcagggcaccccaaacagaccttctctctgacctttgaacttgctgaacccttttccacctcagggcgtttgcactgtctcttccctctgccaggaacactgccccagagttttacacagctgtctttttctgatcctccaggcctcaaatgccacctcttcagagagatcctcctggtcacttcattaatgtggcccccagctgagtcactgtcagccccaggctccatttatctcctttacagcacctaccgctgcaggtcagagtctaattcatctgcgagtttgtgtcttcactgtcaccctccaccggtgccatgagatgggaacacgtctgtgccctgatgaagcccagcacgggcaccatgcctggcacggaggaggcacttaggcagtgcttcttacatatgcacctcagggaatggggccagcggtggtctttccaggttctctacccttccctccccacccaaatgtgtgacattcagagacagagacactggagtcatcctaactgctcccctcctggtcatcagatcccagacccacaggacagggatgtctgaggaggcccctctgggaggtgttcatggctgtgaatcactgtagaagggaacgagctgggcagctggtgcccttcatctgggtcagagccaggcggagatttgaagggaatcctttggcaaagagcaagcaaacctcccagggatggcgacttgtcagatgtcagcgagtctggaaaccagcaatcactcctaatccaagaatcagcctgagggggcctgaaggggtcctgcaggccttcatgtcaccttctgcagaccccatgttgaaaccccatgttgaaaccagcctcgacgccaggaatctctcattaggtataaatgtcgtcttaaaagattccttcacttcttccaccacccatcctgaagacagacaattaatctggcaaatgctgactggtgcctactctgtgccaggctgcaccctcagcataggggggatgtggaaacaaaacaagctccttgcacccctgagctcagcaggtcactggggaagactgttgctaagcaagtgacgacagaaagcagagaagtcatttccaacagcagcagaatgaagcagactcatgtgatccaaagtgtcatggggttgcatgtgtcagtgtgagcaattgggaaaggctcctgagggtgggggtttggagcagagacgtgaaagatgagaaggggaaaaagggaaagcgactcaggctggaactggtatgacagtgccatgtctgtggataaagagcaggccgtgtggacactgcagcaagcccagcagaaagcgggtcatgatggggcccgaggagccagcaggaccccatgaccctgggccacagtgcccatggtcaggtctgggatttcatccaaagcgtaatgggaggatttgtagcttgagaaattttaaacatccatttagctacggtactgagaatttacaacagggtatgagagaggaatccagaggccccttgaggaggctgttggcatccaccagaagagaggccagaccaggtgaccacatgggaatggcagacagagaaggctgatctttggggctttctagtgactaatttgcctcctctgagccccttctcattccttctcttgttctacacctagagcattttatttatttatttatgagacggagtctcactctgtcacccaggctggagtgcagtggcacgatctcggctcactgcaagctctgcctcccgggttcatgccattctcctgcctcagcctcccaagtagctgggactaacaggcacccgccaccatgcccggctgattttttgtatttttagtagagacgggctttcactgtgttagccaggatggtcttgatctcctgacctcgtaatccgcccgcctcggcctcccaaagtactgggattacaggcatgagccaccgcgcccagccacctagagcagttttgaacaatccatcatcaacccgaagaccattctgaagccccctcccctccacctcctcacagtctctgctgcagataaaatcgcacacacccgttaacctttctgctgagaagttatcatcagccctttcatcagtgcagcagctctcagccggctctgaaaggcttgaaattgtacatccatttaaatgcctcgcactttcctaggatttgttaatcactgtttttccacccaaacatgaaaagaggttataagaggtgttcgattgaaattgcctgtgtgtgacaaatgtcagagcatttccaaagctattctctttagtggaacctttttataaggcccagctcagtgtctgggattaagtaggtgttaagttttcttactgctgcctcacagattaccacaaacttagcagcttagagcaacacatgtttattatttcacagtttctaggggtcaggagtctgggcatggctcaactgggtcctctaccccagggggtcttgcaggtgatcatcaaggtgttggccaagggtggaggctcagcggacgaagccaccagggaaggttctgctcccaggctcacatggctctgggcaggagtcaggtcctggtaggcctcagaatgggggctttagtcccttgcaggctgttggccagaggtcaccctcagttcctggccacaagcatttttccaatatgacaacttcttcatcgaagcaaaggagtcagctagcagcaagacagaagtcacgaccttctgtgacataaccacaggagtggcatcccatttgattttccatattctattgcttaggatcaagtcacaggcctcatctacactcaaggggaaggggtcacacacaggcatgaataccaggagagggagactttggggggtatcttagaggttcaaatataaagtaaaacttgaagaaaaaattttaacatcaccactgacacaatcaactaaagatgagcaatgttattttggtgtatggcttacctggatggatggatagatgggtggatgaatggattgatggatggccaaatggaaggatggacggatgggtggatggatggatggttggatggatggatggatggatggatggatggataggtggatggatggatggttagatagagcaacctaataaaaacatatcacacaagacacacatgtgctttttgtcttatgaaaatggaatagtggttttaatacatacagatgtaaacccgcctcgtgtacactcaacaatattttatcaacttgacaatgagaactctgcatatcaacattattgttttttagcactggcatttatggatgtaccacaatgtattcaatgaattttgtgttttaatcaagttaggatgtgagtcagcttcatctagcagagctctaacttcaactaagacaaaagtgtatttttcacagaaaccaaagctggagcttgacagtctagtgtgtatacaaaatttgagggaccctgttttttttccagtgaactgttctgcacttcctaggatgtgaatctcaccttcacagaacaaattgatgggaagagcaccaaccatcacatccataggccaaggaggagagaggaaacaaaaaaataagaaatgaggcagaagatagatgtaaggtttcaaaaaatgccacacaacactttcattactttgcattggtcagaatctggtcacatggtcacagcttgctgcaagggaggctgggaaaacgtagcaagtgtccagccactggggagagaggagcaccggaggaagggcaggaggctaccagcaagcatttaggcttcctactttcttcttataaacatctttagagattcatctttgcatatttttctgactatttcctagggataaatgcctataaatggaattcaggactaaaagatatgcggcactttcactggccaattgccaattgccctctagaaaggttgtaccaatgaactcacccaagaggtggggttctatttcatgaaatgtttctccaccccacatttccttttaatccacaccctttggcctttattaggcttacacatctcttcagaatccttgcttcctacatcataatcttgggatttaatacatgtttttcgttcaggttattattaatatcagatttatctggctgtgtgtgagcccagccacagctttagggaaagagatgtatctttcagtggtgaagagaataaaaatcaaaaatcctcagagatttgaaactgaagtgggcagggaagggtggaaagaacagatctcattctatgaagagcatggagggattttcacagagcatgtagtgctgagtacagcagaccaagcacccggggacacccagagagcagcctttcctcaacagaagaggagtgagcaccacacagagttgcagaaagggaatcccagacaggggtaacagcagatacaaagacactacagcaggcactgacttggcctgctggaggagcagaaaggaagccagtgtgtctggagtagaggggaccaacttgtccaggtttgcccagaactctcttggttttaacactagaaatcttatgtcccaggaaacttctgagttacagccaagctgggatgatttgtccagaactgcccctgttttaaaatggaaaggtctgtgtcccacaaaccccctcagtcctgagcaagctgaggcagtaggtcaccttatgctggagaaatgtgtgcaagggtgggcagaacaagtgactctctcccatgtcctctctccccttagccacaggagtgacaaatctgggtaccgacatccaggatgaagactacatttcccagcatcccttgcagcaaacagaggtcatgtgaccaggctgtggtcactgggaggttaggcctgtgcacagtggctgcctttagaggaaggaaggtttgtgccctcttgttctcttctcccctccctgctggctggcaggagacaggatggacactgggcgggggaagccacactctaaggaagtcagactaacaagatagaaggaggctgagaccctgaaaactgcagagaagaatcacttgattagctttgactttcttgtgaaacaggaatgaacctccaccttggctaagccactgtgatccagggtccttggtcacattcactgaggccataatctaattggtagaaagaaaggaaggggaggggagatggagtcagagaggcaggcagaggtcagatcacatctggcctgtaggccaaggcagaggaagaaacaggtgacccaggactcaaggactgcacctgctcccaggcaaagggagtttgccctgggtgcccctccctgtctgctggaataagcaaattttacccacttcccttaggactttgcaagatgcacatcagtcacaggtgcttgtctcctaagggtcctttcaggtgagctgccccaacagtgagactgtgactagagcaggaaagaacccttgtgtgcatcccctctgagcactgggaggtgtggttgtagcggctgctgttactcatcctgactgatacacagacaccgctggtagccctctctcctggaaacgccatgtaagttaggtgaggcatgacccaggaaagctctcaagctgacttcccttctatccccagggccgctgagcaggacccacattatctaagatcagttggacacctgtacacctgcatggcctggagcaggtgccaggcactgtggatgatgaatgcgagaacggcatcatccctgccctcctgcaggtaactgtctggtctgctcagactgtgagattcctccacaaccacctcctcacacacagctcactcatgccaagcaggaagcagagcttgggatcgcctgacccacttgccctcacctgggagcaacttatgtaacaacacatgtagttcacacagggctgacggttccagcttccaagacaccccaaggcttccttggctgcttggtaatcagaccaggtatgtgcaaagaggcatgactctattttcacttaactgaaaaaaccacaccagcaaagagagcatccatgttcagtggccctttctccccccaatagtgaccattaacctttaaaaagatgctttatgagtcatttgccaaacctccttcttcatgccaaggtgtaatgaggctcataaataggccagacttgagaggggacaaacacgagaaatgccaccaatgagagccccaggcagagcaggtctcagggctgcccagccatgtgtgtgccaaacatggatgtgtcagtggccatgccaggagttaagccctcagccatgggcctctgggtggccaaggccaagtcttattcaacaggtgagttcaactgagccaaccgtggcagaaatacataggggagacgatggctcctctggttaaatcccctgctaattccacctggctcagaggaggaaccaagtcctcataatagcttgcaagtcccacctgactcggcctcctctcagctcagattctccgtgcccctctacccttctctgtctcctctcccaccacagagaggggatcctacaggttcatcctggtggattcaaaacccatctttgttacacagtcaccaaatgaatgtgcataaaccataaacagccctcttgaaaaagagaaaggcaggccgggctcagtggctcatgcctgtaatcccagcactttgggaggccgaggagggtggatcacctgaggtcaggagtctgagaccagcctggccgacatggtagaaccccttctctactaaaaccatgaaaattagctgggcattggtggcatgcacctgtagtcccagctactctggaggctgaggcaggagaatcgcttgaacacggaaggtggaggttgaaggagtagagatcatgccacttcactccaacctgggtgacagagcgacactctgtctcaaaaaataataataatttaaaaagaaaaaggcaaaaattatggccgggcacggtggctcatgcctgtaatcccagcactttgggaggccgaggtgggcggatcacaaggtcaggagatcgagaccatcctggctaacacggtgaaaccctgtctctactaaaaatacaaaaaattagccaggcaaggtggcgggcgcctgtagtccaagctactcgggaggctgaggcaggagaatggcatgaacccggcggggcagagcctgcagtaagccgagatggcaccactacactccagcctgggtgacagcgagactccatctcaaaaaaaataaaagaaaaaagaaaaaggcaaaaattcaaacagctaaacagaaactggacaaaagagttgaaccagcccttcacagaaggggaaatgtgaaggaatggccaacaaacacatgaagagggtctcagcctaacaggatgaggtaccacgtgacacccaccagactggcaaaaatcccacaacccaagaaatgcaagggttggggagaatggagagcaacaagaacactcagccactgctaagaaaggttgtgaacttttgttgttgttgttatgcttccatatgaaaggctgtgtgttgtgggttatgaggaaaattacatttcttaactgggatgaaattttaaaaattgaaagctactgaccagaagaaacttgcatttgtgtacaaaagaaatgcccaagaacgttctagcaacacagtcctaagggcccaacctgcccaaaccctcatccacaggaaaatgaagacatttcccacgttcccctcataccacgggcgatcacgcagcaatgaaaatgaaccatgtcagtgtggatgggtctcaggaagagaatgcaggacaaaaatagacatcgagcaaatgcaaatgctcagacccaatgcagcataggagcagccacacaggagaatttcttcacatccaagttcaaaactacagccgaggcaacagagcaagaccctgtctcaaaaagacaacagaaagttcaaacactaaatggcatattgtttagggatgtacacatacgtggtgaaagaaacgtgctatgaagaaaagtacgggattaataaagactaaagtggaaagtgattccctctgcagaagggaagggactgggattcgggaggggccgccagggaacatccacagttatgtctcttcagattctgttccctaaacttggtggaggtcctgtgtgtccagtgtgtcgatgttctttataccttgcccatattgtacaaatgcttttttctatttaatatttagaagacagttatacacaagatgcattaaatagcaagatggcagatgaacatcaggaaggaacattaggaacatccatggtgttccatccaggaaccttcaccatggaaacccctgtgctcatgggcctggtctcaagacacagtcagttggggatcagaggccacactcatcgtagcagagaggcaggaacagctgggcgagggtccttctgtgacatctactgcatcactgggctctgtgaagtgactcagctgccagaactcacacaatattctgcaccaaaacctcacgggaaaaatggtaagtttgaagtttctccattagtagcaactctcagattaatctctgtcctccatcgcttctccatgaaacaacgttttatacctttgcttgggtctatttttccatttattttttattttactaactgattgaaagatatatactgtacgtgtgtgattttgtctctatcagccaggataatcatggtttaattcctattattattattaccaacatcctttagtttttttaagcttttcaattcctaagggtaatcaagttctttctgcctcctgagacagaaaacaaatccaaactgtgcaagagaaaaacgaatgcattgatcactaggactcacaagttcccaggtttaatctgcttgagaaacagttacaccaatggtttcaagtggcatcctgtgattcattctctctctcctcctctcttctctctctccttacccaacaccggcaccatatttagcatcacgaacctcagacttaaacagcacaacaggctcctcccaggtctccagctacacaaccctcagacttaaacaacagcagcggcaccagctcctccctgggtctccagctccacaaacctcaaattagaacagcagcactggctacacccagtctccagctctacacctctaacttgaactacagccaccagctccttcctgggtctccggctccacagaccttaaacgaaaacagcagcactggctcctccccaggtccccagctacagaccctcaaacaagaagaacagcagcaccagctccacctaaagtctccagctccacacctcaaactagaacttcagcacccgctcctccccgagtctcaatatctgtgaccctcaaaataaaacagcaggaccagctcctcctctggtcttcagcttcacgaccttaactgtaacagcaccacccgctcctccggggtcaacagctccgacgctaaaactagaacagcagaccagcttctacctaaaacaccagctccgagactctcaaacaagaacagcagcactgacttctctcaccaggtctccagctccacgatcctgaaacttgaacggcagcacccgctcctccccgggtctccagctccacgaacctcaaacttgaacagcagcacccgctcctcccagcgtctccagctccatgaacctcaaacttgaacagcagtacccgctcctccccgggtctccagctccacgaacctcaaacttgaacagcagcactcgctcctcccaaggtctccagctctgcgaacctcaaacttgaactgcagcacctgctcctccccgggtctccagctccacgaaccttaaactaaaacagcagtactcactcctccccagatccccagctgcagaccctcaagctgcaacagcagcaccatctcctctccaggtctccagctccatggaccttaaactagaacagcagcaccagctcctccttgggacaacagctccaagaccctcaaactacaacagcagccctgactcctgcccaggtttacagctccacaaacgtcaaacttgaacttcagcactagctgaagtctccagctccctgaccctcaaactagaacagcagcaccatctcctctctgggtctccagctccacgaacctcaaacttgaactgcagcacctgctcctccctggatctccagctccacggaccttaaactaaaacagcagtactcgctcctccccaggtccccagctgcagaccctcaaactgcaacagcagcaccatctcctctctgggtctccagctccatggaccttaaactagaacagcagcaccagctcctctcctggtctccagctccaggaccctaaaactagaacagcagcaccagctcctccttgggacaacagctttaagaccctcaaactacaacagcagccctgactcctgcccaggtttacaaacctcaaacttgaacttcagcactggctgaagtctccagccccatgaccctcaaactagaacagcagcaccatctcctctctgggtctccagctccatggaccttaaactaaaacagcagcaccagctcctcccgaggtccccatctacagaccctcaaactacagcagcaccagctccacccaaagtctccagctccccacctcaaactagaactccagcacccgctcctccccgagtctcaatatccgccactctcaaacagcagcaccggctcctcccctggtcttcagcttcacgaccctaactataacagcaccacccgctcttccggggtcaacagctccaagactctaaaactagaacagcagaccagcttctacccaggtcaccagctccgagactctcaaactagaacagcagccttaacttctcgccaaatctccaactccacgacccttaaacttgaactgcagcacttgctcctccccaggtccccagctacagaccctcaaactaaacaggagcactgacttctgcccacatatccagctccacgaacctcaaagttaaacttcagtaccaactccttcccgcgtctccagctccacgaccctcaaactacaatagcaacactggctccccaatcccaggtctccatctccacgaccatcaaacttgagttgcaacactggctccacccaaattctccagctccaggatgctaactgtaatagcagcaccagctcctctgcaggtcaccagctccaagactctcaaactagtacagcagcactgacgcctgcccaggtttccagctccatgaacctcaaacttgaactgcagcaccacctcctccctggttctccagcttcacgaccctcaaactagaacagcagcaccagctccaaccaaagtctccatctccacgcctccaacttgaactccagcaccagctccttcctgggtctcatgatccatgaccctgaaaataaaacagcagcaccagctcctctctaggtctccagctccacgaacctcaaatttaaaaagcagccctggctctaacccaggtctccagctccaccatcgtcaaacttgaacggcagcactagctcctcccaaagtctccagccccacgaccctaaaacatgaagagcagcattggctcctccccaggtcttcagcttcacaaccctaactcttacagcaacacccgctcctccccaggttgccagctccaagaccctaaaactagaacagcagaccggctcctactcaggacaccagctccaagactgttaaactagaacagcagcactgatttctcaccaggtctccagctccacgaccctcacactggaactacagcaacagctccgcccaggtctccagctccagggaccttaaactaaaatagcagcaccagctcctctgcaggtccccagctacagaccctcaaactagaatagcagcaccatctcctctccagttctccagctccacgaccttgaaactagaaaagaaacactgactcccccccaccaccaatctccatctccaggaacatcaaacttgaactacaacagcggctcaacccaaagtctccagctccccgacactaactacaacagcagcaccagctcctccctggctcaccagctccaagatcctcaaaccagaacagcagcactgactcctgcccaggtcaccagctccaagaccctcaaaccagaacagcagcactgactcctgcccaggtcaccagctccaagactctcaaactagaatagccacactgactcctgtccaggtcaccagctccaagactttcaaactagaatagccacactgactcctgtccaggtttccagctccatgaaactcaaacttgaattgcaacactggctcctctccaggtctccagccactcatccctcaaactgttgctcctccctgtgtctccagcttcatgaccctcaaacttgaactggggcacccgttcctccccgggtctccagctccacgacacgtgaactgcagcacttgatccttcctgagtctccagctccatgacccttatacttgaacagcagcaccaattcctgcccaggtctccagcctcatgaccttcaaatttaaaaagcagaactggctccaacccaggtctccagctccaccatcatcaaacttgaatggcagcactagctcgccacaaagtctccagctcccatgaccctcaaatgtgaacagcagcactggctcctccccaggtgttcagtttcacgaccctaactattacagcaacacctgctcctccccaggtcaccaactccaagaccctaaaactagaacagcagaccggctcctacccaggtcaccagctccaagactctcaaactagaacagcagcactgacttcttgccaggtctccagctccatgaccctcaagcttgaaccgcagcaacagctccacccaggtctccagctccacaaaccttaaacaacagcaccggctcctccagaggtccccagctacagaccctcaaactagaacaggagcactgactcctgcccagatatccagctccacgaacctcaaacttgaactgcagtaccagctccttcccgggtctttagctccgtgaccctgaaaataaaacagcagcactggcttttccccagatccccagctccacgaccctcaaatttaaaaagcagcaccagctcctccctgggtcagcacctccatgaccctcaaacctgaactgcagcactggctcctccccgggtcaccagatcccagaccctcaaactagaacagcagcactgactcctccccatatctccagctccatgaccatcaaacttgaagactagcaccatttcctttctgggtctccagctccacgaccctcagacttgaacagcagtgccaactcctttctgggtctccagctccactatcttcagacttgaacagcagcaccagcttctccccaggtctccagctccatgaccctcaaacaggaacagcagcaccggctcctccctgggtctccagctcctcaagtctgaggatcatggagctggagacccagaaaggcaatggtgctactcttcaagtctgagggtcatggaactggagacccggggaggagctggtgctaccgctgttcaagtttgagcatcttggagctggagacccagggagccgccactcgaacggtagctcctcccccagtctctagctccatgaccctcaaactcgaagagtagcaccatttcctttctgggtctccagctccatgaccctcagacttgaacagcagcaccagctcctttctgggtctccagctctcctatcttcagacttgaatggcaacaccagcttctccccacgtctccagctccacgaccctcagacttcgacagcaatccggctcttcccctggtctccagctccatgaccctcaaactagaacagcagcaccggttcctttctgggtctccagctccacgatattcagacttgaatggcagcaccaacttttccctgggtcttcagctccatgaccttcagacttgaacggcagcactggctcctcccctctccagctccatgaccttcagacttgaacggcagcgccggctcctccctgggtctcgaacctgcccagcctgcagattttggacttgctagccttcaggatcacattagccaattccttaaactcaacctctttctctgtatgtaggatatggacacctcctgctggctctttttccggagagcccagtgaacacaccgtgcatcaggctccatcattcaccagagcgtctttccaacagactttgctgtgatatttcttaaataaaggtcactccaaagaccctcacctctggattgtaaccaactcagtggcagacttaatccatttctatctgctgacatttctcacatggaataggctgtttgacagattgaagctgtctccccccactccccaggccagtgcacacttatctcccttgaatgttcattttgtgctcattttagagactgaggcacaaagacaggcaaatacaaggtgaagtcagtgacaaataaacaatgctatttaggcattgagagtttgtttttgtgtttgtgtttttttgctaattaattccacctggtagaggagggcgaggggaaagaggaagggagaagtttcctggcagggctgagaggcagaatggtgcctgcacctcctggagtgcacggcaatggtctggctctgctgccttctatgggtaagggcccaccggttttttttctgggacttaagtcacctgggcttatactgagcagccctcagcaagctcttctcacttgcccctgccacccagagctccaggatgccctagttcctgcccctcaaagacctgggactcctgctcctgggaccttctggtcggttctgcttttccttgcttcaggaccttacgtggattctgtcacctgccacctcagaactctgagcgacacacccactgcatgtcacccaggacaggttcacccaagtctttcatcccaagaaggtccttcctggcaccttgtgggctgacagcatctccagggaaccacaggacttcgagggggcctgggaagcatcaagagcttcaggaggggagtctgtcacaggtggggattacggagccctgcagggacccttagaacaggtgggtcggggtggggctgaggtctcgacgccttgattcaggttcctggcttatgtcgacctgtctgaaatctcccacccacagccaagccactggccaccccactgctgccctgtgtcaccctgttttgatggagagctcaccaggctctcccagctgctctcctcttggagcagggagtgttggaagtggggggctgatctgcatatgaacgtggctcttaaccaggtgaggggcttgaagtcctctggggctaatgactgttccatgaataatggtccctcttaaaatgtaattaaacatttatcagatgtatttctacagaaacatccatcttaaggggggaccggatttcctaccattcatatcagtctcctgaaatgaggcagaggcactcccggctccccctcccctccccggcctcagttccctgggccggatgtcctgctggggcctgtggtgcagtttcggctggttcaccccatgcagagcttgatggggttgggttggttttaatcagaatggtaaattgcaaatgatacagggcctgggctctgttgggatacttgtgttgaccaagtcccttgtgaattaaatcatttaatactggaaatggaaaaggccccctcattttccttctgaatgagctgtgaaataggctctgagaacggcctccagagtgaagtggttgtcagggcttggcaccaagatctgatgaggggtcagaagacagggcaccagcaggacagggtacttggggaggcctatcatgatgcgcagtagacgcatcctgtgtcggcagcaccccaaactcgggaggctggccggggtgcagctaacatacctgggatgtgtgcactgactgcatgccacctgaggcaccctcggagcatctgagaaccaaagaatcactcctcagcttcccaaccaggggacaagtttgggctctggcatgggacagctcttgtctgcactccgaatctctgacctttctcaatgcagtgctggggttgacttggcagatgaggctgctgggactcaaatcacctcactggcttgaagtcgtatttaatctgctcccaagaaggtggagccaaggactagctggtcccagccatgaattctctgaaaattagaagaataacaaagcatatcaaataggattaacacaaacacttttcaacacagtgcctgtgaggcaacagaaacatgagcacaggatgcccatcagtggggggccaccagggcccaatgtctccaaaagcaacttgctggatgtatcaagagcttaaatttaaaaagcacttaatccctgatgcagttatcacacacataagatattatcttaaggagctgtttataaatgcaaaccaagattatgtagtaatatgatcattgccacataaactgcaacagcaaaagttggaagcagtacaaatgtccagcaacataggaatggagaagagtgcacgggttttccagacagggaaatattgaaggatgatttgatcatatgcttgcctgaaattttcaatagtgtggaaagtgctcgtgatttcatgtgaagtgaaaaaaatggatacaaaaacgtggattttacacttttatcacacacacacccatattcagaggaaatagttaaataagagacagagcaaggtaccaacagtagtaacatgtcagtggtaacattatagatggttttcattttctttttcatagttgttggtatgtttcaaaaatgatcaggtctttgaaaatcagaaggaaaatcagaagcaagagcaccaattgctaccaggtgaaaaccacaatattctctagcaatttctgcaaactataggatccttcataaaatatacaggtcctttaataattgatatgttcaatttttcaataaaaattctgatgtaaaataaggaaagaaacattcaaagtattcattttgatcttgtactcatgtttgagaaagatacagagcagtcaaattactttggaaagtgtaaaaattggtggtttcattttaaattgctacctctaacaccttcatgtgacttcagtaacctatctgctccctgacaaccttaaagtgcttaattaccacaaatttctgaaataaatctatcatttgaataacctttgtgaaaatcagtattgagtgcttttacatgatttgatcacagcaatagaaacagtcccatttgtctctgcacatgcaaatgacttattaacattcaagtgatgagttcactttactgagattcccaagatatgcataatccccaaacattactaccctccctaaagtcctttaatatcatccctttgctctaggacgccctgattcctcaccagcttacattcccagcagcatctggccgtcttgccctctctgctacccctggccttatcacagttcctcaaactgaacaggctcagcccaacccagcaccttggcacttgctgtgcttcgcagagctcccatccagttcttgccccactcagctccaccctgtgggatgttccttagttccaagaaggcacggcatcctcctcacccccagtcctttgcacacgctgttccctttgctaaaacattcttcccctcccaccacctgcagttacctggctaattcctgcttccctttgatagactttccctccattctcaaaccctatgccccaagctcctgtccccgacccaggatcaaactctataatcccccaaatgtttcctttgcagcattttgcacattcagttactggatggtattttcattgagtctttgaatagttggcttcccgtctggtctggaaactccatgagggcagagaatgaaagtcatgcactcaccccagcaggttgcctgttaacaaagattaattgaatgactggtagatttgcacagcatttaggcttttgtgccctgtgctggaatcattctgtgcttgtatattaagccactttacctgagtggaatttcctttgtcatactacctgcaggtttagtgaaatgacagtccctgtggaggacagagaagcctccagctgcctccctatgctgggatgggaatgggggaacaagactagatggatccatgaaggaatgaaacacaccacacaagagcaccagtatctgttcacctgctacacatcagtcattaatggcatccaaaaggaaaagaccctttctcctgtatgacatccatccctgtacctgtcccagccctggaaccaccagaaggaacagcggagaaggggaccccaagccttagttagaagtgagtagggggagaggaaaagcttggaattaaatgtgagattaaaatttagatttggaccagcctaggcttttactacctggatgagagtgagaatgattgatgagcttgttcttataaatagaagtgggccaggtgtggtgggtcacgcctgtaatcccagcactttgggaggctgaggcaggcggatcacaaggtcaggagatcgagaccatcctggctaacacagtgaaaccccgtctctactaaaaaaaatacaaaaaaaattagccgggcatggtggcgggtgcctgtagtcccagctactcgggaggctgaggcaggagaatggcataaacccaggaggtggagcttgcagtgagccgagatcgcgccactgcactccagcctgggcgacagagcgagactctgtcacgaaaaaaaaaaaaaaaaaaaaaaaagtgaacaaaagcccaagggatcttcccaaaatgtcatccagaagcaggggcctgagacctaataatagggcaaggattaggatgaggcaagggagacactcaccccaggcataaaatctaaatgggtaccaaaaaattcaataatcatcataaataacatcataacacagtactttttaaaactcaaacttcatgcaaaaaaaccgattaacaaaatattaaaaatttaaagacaggatcctttgtgaggaaggaggaggaggaggaagaagaaagacggaggaagaggaggaggagcagggggaaggaggaggagggggatgaggaggaaaggagacaggattcaaggcagcacttgcacaatttggcctcacttgctcaccctaacccagccctgcctcacagaagctactggaaggcagctgctggagaaaagtgaagccgtttcccacttgtatttagttcagaccttccgtaaaccagctacaggagagacagtgatgacccacctgtgccaaacagggctgaaatctaccatcaggaccacgataaccgggtctgtgttgcccgttcccagctgcgctcagacactttgacttaaagcctcaggccagggttgcttctctcattgacattgagaacttgttaagagaagtaagtctcagttataggaagtcagatcttcccaagggatgcaatcaaggagtttatttatttaaaatgcagctccgtgtaggggtaggaaagggaatgattcttttttttttttttttttttgagacagagtctcgctctgtcacccaggctggagtgcagtggtgtgagctccgctcactgcaagctccgcctcccaggttcacgccattctcctgcctcagcctcccgagtagctgggactacaggcacctgccaccacgcccggctagtagagacggggtttcactgtgttagccaggatggtctcaacctcctgacctcgtgatccacccaccttggtctcccaaagtgagctaccgcgcccggccaggaagggaaattattcttattcttgttttcatcttgattcattttctctgttgtgtcatctctggccatgagcctgtcacttctgtaataaaagagcagcagtcaatagggttctatttggaggggaaagtacaggctgcccatcaacatgctcaggtttctcccagatcagccccaaggagcaagaacggccagcttacaaggacaggtctgtattctgtggatgggccagaaagagggtatgcagcgagggaatggtaataacgtaggagaaaatggccagggtcacagcctggtttgtccccttctcactgggggcctgcagaaggctggtccaagccagcgacatccgtgcataggggtcaaaatggactgggacccttcatttgcttcctggtgtcttgagatagcctcccacccaccagccccactgtgggtccctgcactggcttcaccaagaagaaactgggaggctgaggggctgacctgcggggagatcttttactcagtccctgtggacctgttgaatgtttaacttatccttaaaaaacatgcctgcctctttgcatgtctaactgtcataaggaacatgtgctactttgctaaagaaggaaaacatcactccagaccacctgtgcatttagtaaacaacaattcgcagcccagagcagtgggtttgctgctgctgcagaaaacaaaagctcaaaacccaggtggagccttcaaaggccacctggctccaaattcaccctcggaattcactaactggtgtgtctggagctgtttcttttttggtgtctggtgtcaggaaagagaagacacagggacaccagttggcggcttaatcacatcagacccaaacctcagttctgtgtgtcccatctagacgccactggggctgaatgaaccacgagctgctgccctgagcagggagtcgaatccatccttgatcagatggctgaagtcgcgcacaccctctagggccctgcatgggggtggggaatcacccgttggttttatctcacagcagggatgacccctcactgggcaccccagctcagacctcaagggaaacaggcctgaggaaagatgggtggaaggatggggcccctggtgggaggactcacagggtaagagaccccacccacttaggcaattcacactcggggtctttggggccctcgaaggaaaccgttggttcacagtgaacacagacaggtccagctattcaggatcacaattatctgcagcagggacaaccacccactgccaaaagatgaattcagtaaggcagaaactttagctcatgatgaatttcttactgaaaatgatttctataatcatgttttatttacctgtatttaaagattaaagtttcaatatggcaccttaattccttaacaaagagaaagaatgcatatcttgtggtaacggggaccagcagctccatgaatcaaagctttctgtggctcgatctagttcagggtatgagtgatacatttaatgtgccagcaaaagcctctggtaaacagggagcagcgttacagccagcagagcccaagggcttgccggagctgatggagatttaagggagcaggttcgagctcctcctgaggcagaatgagcggaaggctctctccgtctcctgagtgtcaggctggactcaaaagggagagaaaattgtttaaatgaaacaaaacactgtcattgcaatgtgacattctcttcccttttttttccttttttttttttttttttggacacaggttcttgttctgtcacccacccaggctggattacaggggcatgatcttgactcactgcagcctcaaccttccaggctcagatgatcctcctgcctcctcagtagctgggaccacaggcatgtgccaccacatctggcttttttttttttttaagacatgaagtctcgccacattgcccaggctggtggattacaggtgtcagccaccacacctggctcccttccctatctcacctgacagtgtctctacatccccatctcttaccactctcccaatttcttagatactctgtccccatctctgatcctcctgatctctggcctttgcacttgctgttccttccacctagtgtgctgttccctcaaatcacccatggcagccccttcttatccttcaggactcagcccacatgtcacctcctcagagaggccttcccagaccacccaaaatgagacagtagctccacccccatgactctttatcccatctcccaatctgtgtcctttattgtatctttcacagtctgaatgatgtttatgtgttgacctgcatgctgtccatcctcatagactggaacttcctgagagtgtcatgagatcagatggctcttacggctcttactcaccgctgtgtcccagacaccagcacagcagcctgtgtttaaagatggtctgtcaatatttgttaagtgactggacagatacggaagtggacagttacactgacagtttttacagggggacgtgttgctttgtcttcgacttgttccattgttctcgtatataacgtgggcctgaccagaaggaggtgctgcttggacatgacaaaaaactttcacacaatctgttggacaataaaccacataagtaccccttctctatccattattctacacctttgtggatacatcaatagatttcatgtgggctcaggaattttgaaatatatattttaacaaattgctcatatagacagggatcctaaaatatagacagacatatagatagtcacctgagccctgcacactctacgcatgactttgcaatccatcctttgaggaagtctgcagcaaagacggcccttcagagctgtgatgaatcgagtcaaggggctggacctttagacccctgtgtttactactagtctttggagatggagggaccccaggaagggtgactgggcaaagcagctcctgtcagccaggggcattttctggggagggtctcagctgtgagctctcagcaggcaaccccctgggcagtggggcatgcatgcctgctcctgaaaggggatgtgggggacacatcccagcatctgctccaagccatgaatctttctcaccaaggccattgtgcaaaagcttcctgacaggcctcccttcttccactcttgctttccctattttccacacagcagccagaggaagcctgtgaaacccaggtcaggtcctgtgcttcctctgctcagaactctccatggtttccacatactcagagtaaaaccccgagcttcatgataaccatgaggcccgcagcttctgcccccaaggcttctctgacctcacctcccgctgctcctctcctcactcggccgcagctgtggctccctccctgattttcctggaacatgccagcacacctgttgctggctttgtactcactattcttttgcctggaaggctccacccttgtcatcctggcccacagcctcagctcctccggtctttgctcaaatggtggcttctcagcggggtcttccctgaccatcctactgaaaatcaacaaccaccccccatagggggttgaacaagggccccccatacatgtctacattcaaacccctgggacctgtgtatatgtccattgcaaagaggttttgctgatgtaattaagtaaaggatcttgagatagaaagatgactctagatgacctggctgggcccagtgtaatcacaggggtccttataagagggaggcaggagagtctgagtcagaggagctatagtgacagggcagagactggaatcatgtgcttgaatatggaggaaggggccgcgagcccaggaatacaaggggcttaaaggaaaacacaggccagaccagcactttgggaggcagaggcaggtggatcacttgaggtcaggagttcgagaccagccaggccaacatggtgaaataccatctctactaacacaaaaaaaattagccggacatggtgcacacacatgtagtcccagctacttgggaagttgaggcagaagaatatcttgaacccaggaggcagaggctgcagtgagccaagattggaccactgcactgcagcctgggcaatagagtgagattctgcctctaaaaaaaagaaagagacaaagaaagatggcagggcggggtgttggggagagagagagagagagagaaaagaaggaaggaaggaaggaaggaaggacaggaggaagggaaaggaaaggagaggagaggagaaagaaggaaagaaagaaagaaagaaagaaagaaagaaagaaagaaagaaagaaagaaagaaagaaagaaagaaagaaagaaagagaaaaaagaaagaaagaaagaaagaaatagaaagaaagaaaatacagacactgaaaacgcaaagaatcctgccctcagcgcttctagcaggagccagccctactgacgccttgacttagcccagtaaaaccgacggcagactcctgacctccagagctaggacagagtccatctgtgctgtttgaagctatcaagttggtggtgatttgtcacagcaaccacaggaagctaacacaccctcccacatacctggagcttcctatccccaagcctgctgaatgtctccctgtagcatggattagcagctgacatgtgtacctttcactgatttgtttctccttctccacttactgaatgtctgcttcataaaagcaggaattttgtttgttgcaagatcccctgcacctagcacagtgcctggcagatagcaagtgctcagcaaacatcctctgcaatgctgtacctgagtcctgaggagggaggaggagcagatactgggatgagccaggggacagagctcccggcagaggcagaagcaagggtagagtctgagtcacaaccaatcccatccttctagatggctgctgtaggacccatggataaacttcctcctagccctgcctccacagagaagtcccttcaactgaagccatggaagctggaaactcacttaagagcccctacagtgagagattaagagcataggccctgaagccaggctgcctaggttcaaatctcagctctgccactcagtagctgagtgactctgggctagttaattaacctctctgtgctaatttccacatctacagaataaggataatgatagtgcccatctcatagggctattgtgaggattgaaatagctaatgcatttagcacagtgcctgacacacagtacacatgatctgctcttcctatttgggtggaaaagtccagcaagttgcaaagattgctaaaaagcaatgagagtataccaaggtgtctaaactgacaagcaaagggtatgattaaaagacaagccaggttggcagcagaacatcagctttctttgtgcctgggccatagacaaggaattgaaaggtagcctggcaacgattcgagaaaaattaatcacccctgctgccttcctgcccctgcccatcccatttaacctgcactctcccgccccctgccctatccctaaagggatcctggagcctcctgttgcacaggccgggctgtgacattcacaacacaccccagctgggcccagcgagttgttttccagccccatctgcccagacacagccccgtgaagagagggccaaatgcacagccagggctgtgttgactgcagaagggatagaagaaaatagatggggtggggtctgcacagtgagggttggtgcatcatgtgggtctcacatgtagcttccctccaacaagccccctgcaatccccaccagatgtaaggagggaggggtgaaagtggggtttccgccagaggtagcagagctggggaggggcccaggctgcagggacctgtgtacagggcatgagatgtcattggggacttcctacatgagacgcagtgagtcatcagggtgcagggtggaggctctgaaggaagagcccaggggaatatgggaaagaggtgacatgagaatccattagccaccaccccagtccttcacatgagaactcatcagccaccaccccaatccttccctcctctgttcaggagcagggccggggcccaggagacagggtgagctttctgcaggagggacacccgccctgagaggaacctgggctgtcatagccgcacagacactgcaagccaggagcagtggccacacccgtggagcagaggaatcagaagggggcagaaacagaggcttgtcacctgagggctgtgagcatgtgtttgccgtgaccaaggggagacaaagcaagtgacagagatgccttctcgtctgcggggattccctctgcaggtctccagggacagtgggtctgaggggcaggaacggtgggggggctatcacaggtgccgcatcaggatgtccccttctgccctgagcagcgggcagtcccctcgaagatgccacgtcatcagcctctggcccgagggcttcccagagcctccctttctccgttttgggtgacttgggcaggcactggcgtctacatctgtgtactcttggcccctagtgggtgtgacctgggccctcccatcagacacacttcaatctcatcccacacagcccagggccaggccttggcacctcatgcacagactcagacaacgcacctgcgatccgggcgctgagactctgcacgtggcctcatcccagtgtctcagagggaaatgaggcttgaatttctcctggcacactggacaccccgcatctcacggtgctgcataagaggatgcttggccctgcatcctccctacaataaccatcatttaataaggccagaagtggagaaggcgaggctgatggggccgccatgtgttcaaaagcagcccccacccacgcacaagcagccctcagaggcgtccaggcagctccaaccagcagataacaggcaccagaatgtgcagagccagcccagatcacagcctggatctcaatttgcaagaaagaacttgccaggttgagcagctgccacgagtccggatggcttggcattttctcctggaggctgttctgagagccagaccgggggtgggggccccttggccactatgggtccctgcagtctgcaccgagcttggagtcaccaggctgatttcatggatgtttatggagcctgcaggagaccatagcttagtgtgtcccctgctaattaaaggacagcagccagttgttccctgtcagagattacaaaggatgaatgctttggacccagggagcggatgggagcatatcagatgccaaaacctggtgcctgccacctggcattctttggaagtgactctttgaggagcactgaccattatcggggagatgggtattggggagcctccctctcagctctgggggctcaactctgcccacatagggcaggaggacgatgtcctgaagctgtgcctgtccttgcccaaggagggttgggggctttgcaggggggtatgtgaatgcctgcaggcctggggatcaggggacctgtgcagggctggaagaggggttctcagccacaggacagccctgcttcagccagtgaagccatgtgtggaaatacagctcagcattgctcaaccttccagcagccaggacaccctgggtttgagtccctgctacggataaaagaaccgaatccgaccatttgtcttcagccattctcagcctctgcctctctccccagcccctccacccgccatgttcaaggaaggcagagcccagaacctgttgtgtggggccttgggctttccacggcctgatcagtgctagtctctggggagcactttgggggacacattcagattctctcgaatgcctcatacccggactgcaatcccccattccaccagtgatttcagtaccgtgtgggaaatttcatcaaatttgcaagtgtgttgtttctccttttacccccattctatctgtgagatgctctagaattcaccagatgtaatatatctttgggatgaatattctatgttaagtcctttgaaagcaatcaacaactgtaatccaattactattggctgtatctttcatgctcttttgccccaaacctcatcctacctgtgtgccaagctcaccacatacacacacagacacacacatactccacaagagatgccaattttgtgcctcgctgcctcacataacatgggagcattgagtagtgaacagctgatctgcatgaattaacgtgtgaggtcatgtgggccctgaagctttcacactcacaaaccggcgtcaggctgggctgtcatagagatcaggtggagggacactagggttccccccaggactccaggcctcctctgatgagcaggtcacatggggatttagagggaggcacaggcacgaactgcgtattaaatacacctgactcactgtgtctgtgagtgtgtgggcgtgtgtgggtgtgggagagtgcatgtaggagtgagcatgtgtgtgagtgtacatataagtgtgtctatgtgtgtgcatatgagtgtgtctgtgtgtgtatgtacgagtgtacatatgtgcgtgggcatgtgtttgtacacatgtgcatgtgtgtatatgtatgatgagcaaatggatgcatgagtgtgtgtgggcatgtgtatctgtgtgtgtatatgtgtaagcatgttagtttgcatgcacaggtgtccaggtcccacatgggatgaaaattgaatagctctaaagatctactggacacatttcagatcctaacagagctcttaagcttgaaagggtcactgaatgcacaatgagtgtttctgagtccaggtggcactgactcagcaatgcaggaaagcagctcctggagttccaggaatgacccccactttctctccctcccagtcacagacccctccccacgtcccttcctctccctctgtttgccttctgtgcctctccctttcccagtctcatttcttgcatgttcatcacttcttcgtcctgcagttcaattcccctccacccctcagcatggactgtgggatgagagagccacagccttatccctgacgtaaccaaaactcttggcaccagcttagacctgtttctcagtcttataaacggtctcaaatcagggaaatgtaaggttctgaggaaaatgatcacaactaggtgattcccctctgtgttaccgtaaggcggtgagacagagattctctaatgtttttagtgcaacccaccgtaagaaacccattgcaaactgccacccagcacacacacgcacatccatttatacagaaacgcagcacgtttccccaaacggcactcaccctcgctgcacacaacgcactctgatgcctcctgacctagtctattctggtctattgcagattttcaatgccgggcttgacactctaaattgatttcaagacccactaatgcatcacagcctgtgacttgataaactccacgctaagacacatcccgttgtgaggtgttcgacccaaaggccatttatcctgcagtgagcagggggacaggattcaccctgaggcgcgcctcctccttctcagtcaggcagggaggagggggctctgtgccatgggacctgcagaggtcctggtctcagggttagtgccctgtggctgctgtgtgtccagcagctggcagggcaggaagattgggggtgggggtgtcactcccacaggcacacagcacccggcagaaccctggcctgaagctgcttaggcctgtggcctcttgagcccacctgggagcaggccctgggggacagctgttgggggcagggactcccaatgcacggaacaggccatgagctgggcaagctgctccttcccataacctcagacccttcttctcacccacctaggaccagctcctgggagcttgcggacaatcctgggcccagagaagcaggcagatgcggctgttggtagcactaatatgggttgtgaatatcatcctgtggttattactttacttaagttacacgccagtacactcgatcctgcacgtgtcccctcacttcacgctcatggggtttgcacgatgggaggagcgctcccagcaggtgatgagggtgataaatggcactggacattcctggagcacctgttggcacccagggcggggcttagtgctccatttgagtctggagtctttactctgccatagcagctgtgtgacccccggtaagcggtttaacctttctgtgcctcttctttctcaactctaaaggtggataataaagtccctgccctcaagcaatcaaaggtgtgttagaagggcttggcacatggcaggcagacagtatacatggttgggattaaccccactatacagatgaggaaactgaggctcagaggcactggcctggcaggcagtgggacctgcacccaggctcgtctgacactgagctctttggcctccctcctttactgctgccttcagaagagacagaggagagggccaccccctcacacgcacacaggggctgaccatccaaggaccccaatcacctggctgcgagcagccctgctcccacggggacactgaccgctccgagtgcccggcattcaggcctcgagccacccactctgcactgcacggggcctccttggaacgcgtccctccccaggggccgtttctctgtgggatggcgctgctctgtggggaggaccccacctccctccttcatgacgacctgcccttacctggctcgtctcttggcagacgctgtcccacgcatctctgtcatttgcatgccaccgtggtgacagtcttcctggccacgggtgtgacagggccttttagtttctgactgacacagtcacagccccatttcacctgattccacttacaaaggcaggtttcccttcccagcctcacatggaggtggtctccgtggagttcaagaggatgtgggctgggaggaggggcagcaaagaaccccagcccaccccaagcaggaggtggcagagtccatccggccgtctggagatagccgagacccttggccactgcagttccccccactgagcctgcccccatccccactccacactggaacagatgctggaggggcaaaccccaaataccctccctaaccagaaaccaaactaccgaaatccaccagatcccagcccaccgtggccagatagtctgactttccaacgaagtcgaaaatacagatttttagaattaaaatgcaaatgttggcaactagttcaaattaatttttttttttcatggaggctttctggtgaaaacctgaccccacctgggagcaggccccggggggaaaagctgtgggagataggaacccccccaccaagtgcaaagaacaggccacgagctgggcacagatgcctcttccccagcctacctgggagtgacaaccggaaaacgtgctagacaaattctgaaagagctgtaacaccttacattattttaaaagtccccaggttgagttaatcccagaccctttacagctttttccttctgattggtgaggcctcagctcaaatgtcacctcctcagagaagccctcccccttggccctatttaagtagcccccaccagagcctcagtcagcgacacgcacccttcatttccttcttggcgctgacccctacctgcaagtgcctcgtcatttgcggttggcatctgcactgtccgtctccaccagcacttaggctccgtgaggacagacgcacgtcgccttgtgccctggtgaatcccaaatccctgccctgagcgcagtgcctggcacagaacagacacaggcaatgagtgctgctgaaagttccccatggagccagtggtgatctgtccaggctctacagccctcccgctaaacgtgttcagagacggggacgctggggccatcctccttgctccactcctggtgaagagccctcagacccataagatgggcttgtccatatcaccttctcaggtgagcctcatacataagcaggttcagtgggttaaccaagcctacatctttaacccacgtgataaccacagtaccaggtttctgccatcaaatcttttctatcctcagtcctgccttgggaattcagactcacccagaattcagagtttcacagactcagaagagaatgtgatgctagattgttctgaaatgtttggttttaaagcaagatcaaatgattacatttgtgatctgaaatcatttgattgtatcaagccatatccccttccaaattattttctttaaattctccccagaacggggaacagtattaattgtttccaatgaaaagactgcccctttcatcaaagccatgagctttatctgctgtttttgaatataacgctgacttagtaaaagtgattgtaaatagcaggtcttctttgtgcattttgtgcttccaaatgtgctagttggaataaagaagtgaaaagtttaaaaatcctctcttgtaaatgtttggaaattgcactagagttatttcttgctctttgaggggagaggtcaccctgcaaatgtacagtcacacctgttcggctcccccgggttttgaatgtcactaaacccccacttccccccaccttggcagatcagactctgtgaaggacgctcactgtctgtgcgacctcacaccaggtacagggaccaggggaaagaggcaagtctggcttgtgggacagtcctgcaaggccacttttctggtagggaggtgacacctgcaaaggaacctctcatttctcccagctccagccagtttcaacaacaggtggggttttctttcctctcaattattatagatttcttttctaataatcaaagtcatgattcattttgaaagtttttaaaaatagaagaaaacaagattttaaatcacgcgtgattgattccaacaccaaagataagcagtattcgcattttgctatggagtgctcctgttagacatacacacacatatgatcacacttacacacttatgcatttttgcttcattaaaatagaataaagctttatgggccaggtgcagtggttcatgcctgtaatcacagcattttggcagccaagacaggcggatcactgaaggtcaggagtttgagaccagcttggacaacatggtgaaaccccagctctactaaaaatacaaaaaatagctggatgtggtgcatgtgcctgtaatctcagctactcggaaggctgaggcaggagaattgtttgaacccaggaggcggagggtgcagtgagccgagatctcaccattgcactccagcctgcataacagagtgagactctgtctcaaaaaaaaaaaaaaaagaagagctttgtttacactaaacaatattttgtgtccatatttacacatagataacaacagatcactatcatttttggtatgggcatatgtagatataagtattacatgaatttcctactttttatccagttatggttatatcacctatcagtgatttaacttcagccaagacagaagtttatctcataataaccaagactgggccgggcacagaggctcacgcctgtaatcccagcactttgcgaggctgaggtgagtgtttcacttgaggtcatgagttcgacactagcctgctcaacgtggtgaaaccctgtctctactaaaaatttaaaaaattagctgaatatggtggcacgcacctgtaatcccagctattcgggaggctgaggcatgagaatcacttgaatccaggaagcggaagttgcagtgagctgagatcacgccattgcattccagcctgggcaacaggacaagactctgtctcaaaaaataaaaaagtaaaaacaaaactggaggttgtcagtctagggtggcgttagggactttcatttccttccagaggacattctgctatccacagggtagaagcctaatcctcaaggttcaaggtgacaagaatagctccaaccatcatacgcttattccaggaagcaggtcaaaggatggaacaactaagaaatgacattaaagatatgtgtcagtccatctgcgttgctataaaggaatacctgaggctggttatttatagaagagaggtttaattggctcacagttctgcaggctgtacaagcatggcaccagcatctgctcctggggaggcctcaggaagcttccaatcatggcagaaggtgaaagggaagcaggtacatcacatggtgagagaaagagcaagagagggaggaggatgtgccaacccctttaaacaaccagatctcccataaactcagagcaagaattcagtcattgccatcgggacggcaccaagccattgtcaaagggatctgcccacatcaccaaaacacctcccaccaggccccacctccaacatcagggatcacatttcaacatgagatttggaggggaccaacatccaaaccataacaagacagaagttatagaaaggggtctccaaaaataccacccaacacttttattgcctcccattggccagaacctggtcacatggccacaactcactgcaaggaagcctgggaaaatgtagcctgtgcccacccaccaggagaggggagcacttttgccagggtgcgggaccaccagcgggcatttatgcttcctacttctttcttcttataaaaatccttgagattcatctttgcatgtttttctgactatttcctagggatcaatgcctataaatgaaatttgggaccaaaagttacgcactttcattggccagttgcaaaattgccctctagaaaagttgtaccaacgaactcacccaagaggtggggttctatttcatgaaatgtttctccaccccacatttccttttaatccacaccctttggcctttattaggcttagacatctcttcagaatccctgcttcctacaacataatcttgggatttaatacatgtttttcattcaggttattattaatatcagatttatctaactatgcgtgaacccagccacagccttagggaaagagatgtatctttcagtgctgaagagaataaaaattaataatcatcagagactttgaaactgaagtgggcagggcagggtggaaagaacagatctcattctacgaagtgcatggagggatattcacagagcatgtagtgctgagtacagcggcccaggcacctggggacacccagagagcagcctttcctcaacagaaaaggagtgagcaccacagagagctgcagaaagggaatcccagacaggggtaacagtagatgcaaaggccccatggcaggcaccaactcatacaggtttgcccagaactttcccagttttaacactagaaatcccatgtcctagaaaacttctgagtctcagccaagctgggatgatttgcctggaactgcccctgttataaaactgagaggtctgtgccccacgacccccctcagtcctgagcaagctgagacagtggattgccctagactggagcaacgtgcatgacggtgggaagagccagtgactctctttcatgtcctctctcccctcaacctcaggagtcacccaggtgggcactgacatccaggatgaaaacttcccagcatcccttgcagcaagcagtggccacgtgaccaggcagtggccaatgcacatgaggccagtgcacagcaactgccattagaggaaggaagatttgtgtcctcttgttctcttctcccctccctgctggctggcagtagataggatggacactgtgggggaagctacaccctaaggaagtcaaagcagcaagatggaagtaccctaagaccctgaaaaatgcacagagaagaatcacctgactggcttgaactttcatgtgaaaggaatgaacctctgtcttagtaaagccaccgtgattcagggtccttgtcacattcactgaggctgtaacataattgttagaaagaacaggagcgggaggggggatggagtcggagaggcaggcagaggtcagatcacatggggcctgtaggccaaggcggaggaagaaacaggcaacataggactcaaggaccacacctgctcccaggcaaagggagtttgctgtgggtgcccctccctgtctgtgtgtccagtgtgtggctattatttataccttgcccatattgtacaaatacttttttctattcaatatttagaagacattacattaaatagcaagatggcagatgaacatcaggaaggaacattaggaacatccacagtgttccatccaggaaccttcaccgtggaaacccttgtgctcatgggcgtggtctcaagacacagtcagctgttggggatcagaggccacactcatcgtagcagagaggcaggaccaactgggagagggtccttctgtgacacctactgcatcaccgggctgtgtgaagtgactcagctgccagaactcacacaatatcattctacaccaaaacctcatgggaaaaatggtaagttctcagtttctccattaatagcaactctcagattaatctctcctccatcacttctccatggaacaactttttatagctttccttgggtctatttttccatttattttttgttttactaactgatggaaagatatatattgtatgtgtgtgattttgtctctgtcagccaggataatcatagtttaattcttattatttttattaccaacatcctttcgtttttttaagcttttcaattcctaagggtattaatcaagatctttctgtctcatgagacacagaaaacaaatccaaactgtgtaagaggaaaaagaatgcactcatcactagcattgagaagttcccaagtttagcttgcttggggtacagctacatctaccatttccagggtcatcctgtaactctctctacttccccaactttggctccatgtttagctccacgaccctcaggcttaaacagcagtactggcccctccccagatctccagctccctgaccctcaaactccaactgcagcaccagctccgccccgggtctccagctccacaatcctcaaactacaacagcagcaccagctcccctgtggatctccagctcaatgactctcagacttgggaggcggcaccggctccccaccaagcctccagctccacaaccttcaaactagaacagcagcaccggctaccccctgggtctccagctccctcaaaattcaactatagcactggctcttccccgagccaccagctccacaaccctcaacttacacagtggtagcaccagctcctccctaggtctccagctacacgaccgtcaaacttgaactgcaacaccagctcctcttcggcctccagctccacaatcctccaacaacaacagcaacaccggctcctccctgaatctccagcgcaacaaccctcagacttgagaggtagcaccgacaccttccccaaggctccagctccatgaccctcagatttgaacagcggtagcaccagctcctgtccaggtctccagcttcatgatccttaaactagaacagcagcactgccgcctccctgggtttccagctccatgaccctaagacatgaatgaaagaactgggtcaccccagggctccaactccaagacccacagatttgaacggcagcaccggctcttcctgggatctgcagctccacagccttcaaactagatcagcagcaccggctcctccctgggtctccagctacacaatcctcagacatgaacaatagcaccggctcctccctgggtctccagcttcactaccctcagactagaacagcaacactggttcctccctgggtctccagctctacaatcctcagacataaacagcagcaccaccggctcctacccttgtctccacttccacgaccctcaaactacaacagcagtaccggcctctccccaggtctccacatccatgaccctcaaaatagaatggcatcatcggatccctcctgggtctccagctcccaaaccctcaaacttcaattgacacaccggatcctccccacagttaaacagcagcacaggctgttcccaaaagctccagatccatgatcctctgacttaaatggcggtagcaccggctcctccccaggtctccagttccacaaccctcaaactacacagcagcaccggctcctccccaggtccacagctccaccaccctcatactagacaccaagactacctcctccctgctctccagctacacgaccctcagtcttgaacagcagcagctcctctctgtacctcaagccccacgaccctcagacttgaacaagaacaacaccatctccccccagggctccagctcggggacctacagatttaaacagcagcaccggctcttcctgtgatctccagctccactaacctcaaactagaatagcagcaccggctcctctttgggtctccagcttcactactgtcaggctggaacagcaacaccggttcctccctgggtctccagctcaacgactctcagatttgaaaggcagcaccggctcctcacaaagtttctggctccaaggccctcaaactagaatagcagcagctgctgcatcttgggtctccagctccacaaccctcaaagtagaaaagcagccctggctcctccctgcctctccagctcctcaagtctgagtgttgtagagctggagacgcagggaggagtcagtgctgctgttctagtttgagggtcgtggatctggagacccagggtggagccggtgctgctgttctagtttgagggtcatggagctggaagaccccgggaggagctgctgctgctgttctagtgtgagggtcatggagctggagacccgggaaggagtcatttgaacagcagcactggcccctccccaggtctcaggctccacgaccctcagacttaaaaagccgtagtacgggcttctccctgggtctccagctctacaaccctcagacatgaacagcagcaccggctcctccccctgtctcccgttccatgaccctcaaactacaacagcagtaccagcctctacccaggtctccagatccacgaccctcaaaatagaatggcatcaccagctcctccctgggtctccagctcccaaaccctcaaacttcaactgacacagcagatcctccccacagttaaacagcagcatgggctgttccccaaaactccagatccctctgacttaaatggcggtagcaccagctcctccccaggtctccagttccatgaccctcaaactacaacagcaacacaggctcctccctgaatctccagctcaacaactctcagacttgagaggcagcaccggcaactccccaaggctccagctccaccaccctcagatttgaacaaccgtagcacgacctcctgaccaggtctccagcttcatgatccttaaactagaacagcagcaccgctgcctccctgggtttccagctccacgaccttaagacacgaatggcagaactggctccccaccagggttccagcttcgggacctatagatttaaatgacagcaccggctcttcccaggatctccagctccactcccctcaaactagaacagcagcatcagctcctccctggctctccagctcccaaaccctcaaacttcaactgacacacaggatcctccccacagttaaacagcagcatgggctgttccccaaaactccagatccacaaccttctgacttaaatggcggtagcactggttcctccctagatctccagttccatgatcctcaaattacacagcagcactggctcctccacaggtctccagctccaccaccatcacactagacaccaagactacctctgcccctctctccagctacacgaccctcagacttgaacaccagcagcagctccttcctgtacctcaagccccatgacctcggatttgaacaacaacaacaccagctcctgcctagggctccagctgcagaacccacagatgtaaacgatggcaccggctcttcccaggatctccagcgccactaccctcaaactaaaacagcagcaccagctcctttctggttctccagttccataacactcaggcatgaacagcagcacccactcctccttccggctcaagattcactaccctcagactagtacagcaaaaccggttcctccctggatctccagctaaatgactctcagactggaaaggcagcaccagctcctccgtggatctccggctccacgacactcaaaacaacacggctcctccctgggtctgtacctccatgaccctcaaactacaacaacactgctcctccctggctctgcagctccaccaccctcaaactagaacaagacttctcctccccagggtgccagctaccgaaccctcaaattacaacaacattgctcctccctgggtctgtagctccaggaccctcagaccagaacaagacctctcctccctgagtctccagcttccggacccttgaattacaacaacattgctcctgcctgggtctgcatctccacaaccctcaaattaaaacaagatctctcctccctgggtcaccagcttcgtgaccctcgaactaaaacaacaatgctcctgcctgggtctgcagctccacgaccctgaaactagaacaagacctctcctccctgggtcaccagcttcctgaccctcgaactacaacaaaattgctcctccctgatcagcagctccaccagcctcaaactcgaacaagacttctcctccccaggttgccagctaccagaccctcgaattacaacaacattgctcctccctgggtctgcagctccacgaccctcagaccagaagaagacctctcctcccctgggtcgccagcttcctgaccctcgaattacaaccaaactgctcctccctgggtcggcagctccacgaccctcaaactccaacaacacttctcttccctgggttgccagctaccggacccttgaattacaacaaaattgctcctccctgggtctgcagctccacgaccttcacaccagaacaagacctctcctccctgggtcgccagcttccggaccctccaattacaacaacattgctcctccctggttcggcagctccacgaccctcaaactagaacaagacctctcctccctgggtctccagcttccagaccctcgaattacaacaaaattgctcctccatgggtctgcagctccacgaccctcaaactagaacaagacctctcctccctgggtcgccagcttcctgaccctcgaactgcaacaaaattgctcctccctggtcggcagctccacgagcctcaaactcgaacaagacttctcctccccaggttgccagctaccacaccctcgaattacaacaacattgctcctccctgggtctgcagctccatgaccctcagaccagaacaagacctctcctccactgggtcgccagcttcctgatcctcgaattacaacaaaattgctcctccctgggtcggcagctccacgaccctcaaactagaacaagacctctcctccctgggtcgccagcttcctgaccctcaaattacaacaaaattgctcctccctgggtctgtggctccacaaccctcagaccagaacaagatctctctcctccctgggtctccagcttctggaccctcaaattacaaccaaattgctcctccctgggtcggcagctccacgaccctcaaactcgaacaagacttctcctccccgggttgccagctaccggaccctcgaactacagcaacattgctcctgcctgggtctgcagctccacgaaaatcaaactagaacaagacctctcctccctgggtcgccagctttctgaccctcgaactacagcaatgttgctcctgcctgggtctgcactccacaaccctcaaactagaacagcagcaccagctgcttcctggacttccagctcaatgactctcacacttcaatggcagcaatggctccacccccaggctccagctccaacaccctcagatctgagcagcggcagcaccagctcctttctgggtcttctgtttcacgatccttaaattagaacagcagcaccatcttctccctgggtctccagctccacgaaactcaagctagaatagcagcaccggctcctctgggatcttcagctccacgaccctaagacatcagtggcagcactggctcctcccctgggctccagctccaggaccctcaaacttgaacagaaacaccagctcctccccaggcctccagctccttgaccctcataaacaatcccttcttatgaaatgtagcagtcaggaaaactgtagaggaagtaaataaataaatggtttcctttcaaattgatgtttcttttctgttcacgcaagtcaggaaacttttctactttccatcaaccttgcaacctacttgcattcaattgtaagatggaaatccatcatttgaaataacctttaaaaacttagtagttcttttttactatgatcttatctcacagctctagaaacgatctttcactttgcctgtgcagaagtcttgtgaacattcaaactatgaatttacttggttgagattcctagaatacacattatccccagatgttcctgccctccttaaaatcttctaacaagttcccctcacccgagcataaatgccagtttcctatccacagcccacagtgcccagcacggccctgccctctgccctgaccttatggtctcccctctgctgttactttcctcccagacaggcctctgtcacttcctcaaaccacacaggctcaggcctgactccgggcctttgcccctgctgtgccccctgcgtggagcgcctttccccggctccccatcctcctcaacccgctcagctccagcctgctggccgcctctcagtccatgaacacacgatgtcctccccccaggcctttgcacatgctgttctctgtgcctgaaacccgtcccccctcaccatctgcgttcacttttctaatttccattcatccttggagtctcccctgaaatatcgccccccgcctgcccccaccacttggacttaaccttgcttaggttgaaaacccccatctcctgactccaggaagctagatgctatcctggcacttggaactttcccattacaacgttttgcgcactcgtaatttattctattaggttggtgcaaaagtcatcgcagtttttgtcattactcttaatgaacggcagcgccagctcctccccgcttttgtttgccattacctttactggcaaaagccggaattactgctgcatcgacctaatagaataatttatatttattcacctatcatctgtcttgccctctagaaagtaagctccatgagaatagggaccaaatctactccaaccactccagcttcctagcacattgtcaataattatttaccgactgactgatagagaaatatcttcattgttgctgggatgagccacataacatgacacgcccctttgaaagtcaatgtcatggacagttagcatttgcttttcactcctgcacctgtggcttggctgggcttaggctgatctagtctgggcttgactccaggctgagggttggaaccctgcgtgctccacacgcctctcatcctgcagctggagtcaaagttccctggggcacgctcgtctcgtgggaaaaatcaagagcattagagggcaggcctggcagtgccaacacattccaggcttctgcctgtgccgtgtctatgaaaatcttgttggcataagcaagttacccagccacgagcaatacctatgggatagataagtctgtccaccctccctcgggccctggtaaggatgtggatgtgtcatactcttacaggggtagtgaaatattgaggcccaacgttaaatcacctacagcaagatatgtcagcctctgtgtccccacgctggaatcatgcttcaccagcgggtttacctgaaccgactcccctttgcaatggtgcctgcaggtttaggccaatgctgttccctgtgaaggacagagaagcctcaattggcctccgactgttggcaagaacaagatattaggttggcataaaacaaccacaagccccaggtggcccgtgcccattgagacaggagaggggcaggaagaactgtgggagctcagggagcttcccatccccagtcccctccctccccctcttgtcccatctccgctttcttttttttcctttttttttttttcttgagacagggtctgactctgtcacccaggctggagtgcaatgttgcgatcttggcttactccaacctccgcctcccaggctcaagcaatcctcccacctcagcctccccagtggctgagaccacaggtgcatgccatcacacccagctaatttttttttttttttttttttttttttttgtagacacaggattttgccttgcccaggctggtgtagaactcctgagctcaagcaatctgtccacctcgacctcccaaagggcagggattacagacatgaatcactgagtccagcctgctttatttttctttacagtacctggaacgttctaatgtactaagtagacgtgtattttctttcttttttctcttccctagaataggagcttaatatgggcaggtacttttgtttgtctcatttatcaccctatccccagtggctggaacagtctccagcacatgaatggtgtgttcttaataaatatttttaacaaataaataaatgaaatatcctacaagagaaagctagtatttggaactcacccatcaacagaaccaaaaagccaaagacctttagcctgtccctacttctgaatgcacccaaccccacaggagccagcagagaaaaaacaggaacaaaggtggggaaaagagcaggtggttccccccgcaactaaggaccctcgaggcttaggctgaacttgagctggagaaaggactaatgtaggaactgggtgtgagataaaagtttagatttgtctggcctggattttgtaacacctaaacacgagttattccattcatttttgtttttgtttttttgagacagagtcttgctctgtctcctagactggagtgcagtggtgtgatctcagctcactgcaacctccgcctcccaggttcaagtgtttctcctgcctcagcctcctgagtagctgggattataggcacatgttaccacgcccaggtagtttttctattttcagtagagaaggggtttctctatgttgaccaggctggtcttgaactcctcacctcaagtaatctgcccacctcagcctcccaaagtgctgggattacaggcatgagccaccaggccctgacatattccattcattattaagaagtctgttatgataaatcaaagtgaccaaaatcctagggaaacttccccagatgtcatcaagaagcagagaccagagacctatcagcaggatggggactagggcgaggcaggggagggaggcgctcatctctggattatcagggtccagcaagggaggtataaagtttaagggggcaccaaaaaatttactgatcaggccgggcgtggtggctcacgcctgtaatcccagcactttgggaggctgaggcaggcggattatgaggtcaggagatcgagaccatcctggctaacatgttgaaaccccgtctctactaaaaatacaaaaaattagccgggcgcggtggtgtgcacctgtagtcccagctactcgggaggctgaggcaggagaatcgcttgaacctgggaagcagaggctccagtgagccgagatcgcgccactgcactccagcctggatgacagagcaagactccatctcaaaaacaaacaaataaacaaacaaaaaattcactgataaataaataataaatattatttaatataaataaaataagtatttaatataaataaaataatattttaatgcaggtttaaaaaaaatcaaatttaatgcaaaaaaaaaaaaaaaaccctagtgggaaaagttatcaacatttcaactaagatacaatccaaccctgcatttgcatgatttggcctcacttactcaccctaacccaaccctgcctcacagaagctgctcgaaggcagcggttggagaaaaatgaatccatttcctgctcgtatctagttcagaccttccataaaccagctacaggtaagactgtgatgacccacctgtgccaaccaggaccacaatctaccatcagggccacagtaaccgggtccatgttgactgtccccaggtgcacccagatgtttgacttaggggctcaggccagggttgcttctcccattgatattgtgcacttgttaagagaaaacagacaagactgggcacagtggctcactcctgtaatcccagcactttgggaggctgaagtgggcagatcacctgaggtcaggagttcaaggccagcctggtctacaaggagaaacctttgtctcttctaaatatacacaaatcagctgggtgtgaggcacaagaatcacttgaacccaggaggcagaggaacccaggcaggccgggaactctgccatgggaagcgggtgtctgagagcaaggtcagtgacaccatcttgttcttgggactgaactggaggcagggaagccaggagaagccctgggacccggcctctggatgttcaccatgggtaggcagctgtttgcagggagatgcctgagggacccccaggttcctcatgaaaacctacagctccggtaaaatctgcactttccagcctgggctgcttcccactgtatgctcctgaagccagacgccttcattctgacccctggcaattccctgcatagacccgcatgtttcaggaggatcctgacctggatctcagaccactgcttcccatggcagacttcccagccaagcatttcctgaaaacggtcttctcagattttcttctgagatgtggccaaggccctgaaacagagtctccctcccacacaggttcttacctgtgaaacaggacatggtgggaatggggaggaaaggttcagccccagacaaggaggccctcccatggggacgtccaaagagaaagatcggacccatcaaacctcagaggctgcccttggacctcaggatggcatccaaacccccacaggtccctgcccccgtccagtcccacctcccaccactcactcctgtgtccacttggtcatggccacactggtctctccgctggccttggacagaccaggcttccaggaacctcagggccttggcacgtgctggcccttcctcctggtatgttccccacccccaccctgatcctcacccagttacctccaggaacctcgtcacctgttaggtctcagatgaatgtcacctccttggggggattctcctgtgtcctcatcacctcctcgcccaggcccagggcccaggtcaggtcccccaaggcccctcttatcacactgtagtgtcttttcttcccagccaggaccacgtgtaatgaaacaaggccattgttatctgaggacaacccatacaactaaaaagcccattcaaggtaaattcaattaaattgagtaccaaagtttcacaacaaatgctttgtgatttagttaacaaacatttaccttggattcactttaggccaggcgctgttccccatactccatgtgtattaaatcatgtactctccaaaacaggcactactacatcaccgtccccattttgcagatgaaaacacagaggcacagaaaggtggttgcttgtgtagaaatcggcatcatcaggactggattaggtcaccctgcaccagaccccctgctctcagccatgtacttgccacttcttctaaaaaacaaaacaaacaatcaaaaaaggtctaatgagggtcttctctagaaaagtaaagctaaatgtgatgaaaataagtttttatttcctgtctaacatttgggttatagtggcagatgtacccccattcttaagtaatcaaagaatgaatcaagtactaatttttttgcatatttttttctgataaaactgtagccacagtcaacctctttcccccaggtttgagttttgcagcctgatcaaaagagtcattttcaaaaacccccaggggctccagagcctccacaggggcccctcttcctcctggcattgtctctattccctttgggatattctgctggatttgaggagatcctcattcctgctggttccacttctttcagtgttcatcagtctacatgttccaggtcctcactgttggactctgtgggtgacgcaaggaatacttcctattgcatggtgggatatacaggctcacccacagccccatggtgaacccaccccacatccgctgtgaaacccctagtaaggaccagaccaatcattcacacccagtggagtgcaggcagccagctctgagaaccaactgtgaaatgttcagaaattttgttaattggtgttaaacctctggtagtttgaaatcagccatgttgggagtatttataccaggaaaactgggcttttcttgaccctaaagtgctggtttatcggcccagcactgaagttatacctcacgcacagccctgacttttggatggaaactaccgttatcctatttggggtcgcttcccagtggctcccatgtccaagaccccagctttctctttctctcttcacccactttggattgggagcctcaaaaccactgtgctgaaaccacttctaggcatcagcaccattcactaacagcacactggcctttgttctaagacagggattcagcagttacatagatgtgcactgagcactgagctgtcctaggtgctgaaatgatttcatcaggagcaatcagaggctgcctagtccaggaatctcagacatttgaccctggctgaatgcccttattggagcaggaaagaagtgcaacagtttgcaataaaataggcccctcatttgccatccagggacacacacaaagaagcaacagtgaacagtcagtacttcacccagattcaagcaacacatcccgacctatgtggtatcctccctgtgacacaggaacggggtgggagaggagttctctagccacttgcctcccaagctcatccatgggaaagcatcttgctcccaagctgtcagggagaaccacaaaacccccctcagccggcaggaagcttgccccaccctcttccccattcaccccctcactttctcccctcctccactgacactcctcaactccctggactgtccactcagccccagaccttctctcttctgcccccactgtgtcgtgactgtcagccattcctccctagtccagaaatgtccatgagggtgagagagcagggggaggacaggaccctccaggatgacctggcctcagaaaaagagcatctaaaacacatcggaggcatcgccttgtgaagcttcaactgccagcaagtcccatccacagattctgtcttctttgcacaaacagcatctgcctccttcctggcttgttgttatcagaatctcaagagatgccagaccccaggaaatgtggacagaggggctctgatctgtctcatctgtttgactatttgattaatatcctcccttgctctgccttccccaccatttcatcatcaggcccagccacaggcttggcacgttgcaggcgctaaacaaatactttcctgaacaaatgatgaacactttggtttggacgggggctattaactttttgaccttagggtgagaaccatttcacacacactttcaataatcaagaaatacttaattgtaatttattcaagggtattttttctttctgagatgtttagttcctattttcgtttctttgtccatgtgggaagtaaacagcaaattgcctgcatgtagaatgtattcagtggagctgccttaattagctaatttactcatgtctcactggagagcaatcagaaagagtccttgtaggtgctgtttaagtttgcaaaagtgtccttcccttccacagccacagatgtcctgggcagctggacctggggaaggggcaatatattcccacccactcaccctaatttccacacccagccgctgactccattgtaacagagcactgggcaaaacattcctgtgcctaacattcttcctcaggagcgtcttcaaattgtggcggaagcccctgagtttatgcccgtggagctctgaaccctgcaaagggctggccaggggtggggaggctgtgccccaccctccactcagggctcaccccaagtcccccaggggtccccagtactcactgtgaagcaagaagtggagcaccctgatggggaatggccctgccagggtcatgtcccacaaactgtgtaagcaaaggagacagcacctgctttccaaggcctgcccaatgggccaaggttcagcttaggtgagagggcccggctatccctacccatgtttcagctcaggggataaaacccttcctgctacaaagcttccttttacaagcagataaaccctggccaggacttctaaaatctttacattcaggtagcttttggccaatctttggtgaatttgtttaatcatatttctttactggaagtcattatctgagatgagcaattttttactggggcaggtttgtgacttcaatgagccttgccttccttgtctcttaaaggtcaccattggaaatagatcgacaatgtagcacgaaagtacctagcacagtgcctggctcagacattctatcagcagctacctgcctccagtctgtcctcctctctgttttctgcattatctctttctgtagtataaaagagacaacttttcttcaaagctgtctagattttagcctttggaagttcaaaaacattggccagttacccatgtcatagtgaggcaggagaatagggaattggggtaaccaaaggttaagacataaagaacagcaggtgcagccaattttaggcaagattaggcagcacacagtccacaccctcacttctgcaataatgagacacaaggttccacttcagcctctgattggtcatggaccaatccttcatagggcgtatccaatcagatgcctctaaaagagcacctagaggtgttaccaaattcttttagcttaataaaaatccctaaagaacattgtaattggggctcttgagcaacttgcttgagcccactcccactctgtgaagtgtactttcacatcagtaaatctgcactttctttcgttgctttgtttttctgttgctttgtctgtgcattttgttcaagtctttgccaagaacctggacaactcacagtcaggactttccatctggtaacaatagcattaattgcagtaaaaggatgagctttctcagggcaggctaagcccagctgcccacagtcctgaccacaatacctgtcccttctgattttttttttttcattttttccccaatttcttagctttaaaaaatgtcaactattcagaaacatacagagtagtacagtgatcacatacccttcaaatagcttcatcaactgataacaccatgtgtgtgggtcacctatctccacgagcattatttaaagaaaattgtgtgtgcgcatgtgactgtgtgtgtgtgcatgcatgtgtgcacacaattgtgcgtgtgtgtttccttttctggcaaaactatttgaaagtatggtgcaggggtcatgatagttcacccctaaacacttcagtgtatatctcctaaagaaaaaaataatttcttacataatctcaatgccattttcacacccaaacatttcatgttgatgcagtgatataatctaaaatacagtccaaagtgagagcttttattttcaatttagcatccaatctaggaccacactgcatggcttgacatgattctttcattccctgcaatgtcaagcagcgagtccatcatttcatctcttgggatgttgacttctttgaagattccagccagtcgtattgtaccagaaagccaagaagtgctcaaaagatgatggaaattggtcaaaaggaaacagaagctatagtcagaggactttcaatggacaaatgtagaagtatttgagcatcaaaaatatatgggagcaagaatgaacacactgaattttttaaaaaaggatctatgagttcatagtgatactaaaaaaagctgattggagccaggaagaattctttacagaataacagcagctgatatatatgaagaatgacggaatttgaaaatgttacaattgactcatttgaggaccatctgtggatgccaaaaccattgggggacagattttgaagaacaggatatccataaggtcccaaagcatcaccgcatatgttgcttggcaattacacaagggaaaaatgatcctttgcaatagagaaatctgatggccagcactttaaccaagtgctcaagctcaacacgagcagtgaacagacatctcaagcctcactccggctgtaatgagctgggcagagcctccctctgtagcaatcctggccacggcattcggcctgcacctccccagggaagaagcagactcgggcagactgtggcccttctgcaggccagcgacacaggctcgtctcacttcacctgggtggtacagacactggtccacagacactccttgctttgagctctgccccgtccagacctgtgctggagttacagatacagagatggatgatttgccttcaaggatgggaaggatgggaaggatgctcaggaatctgtgtccggggtctctggcacttggacagcttccaaaacaactgtgactcctccactgaaggaagaaatgaaaatacacgtatctgttgtttcttcttcctgatcaaaccaggtggaaccgtttaggaaaaaatctgttgttagaggtatactcaggaacgatttgtggactcttggtcgtcctatcaagtgagacatcggacgaaatagggaccactatcgtcactctgccatcaggattcgtgactgcaacatcaaaaggcgctgtagaagcattggaaaagcacctggtgtaaagggagcttttatcagtagtctgagcccctctccattgctgctgctgttggaaaagccaacttggctgcagacagtagcaacaggcttcagagtcagcccagaagcagcaggaggtggagtctgcaacagccaaattaggggtgactttgcctgggatctgggttctttagagatgccaaatattcacttcagaaggctgcagaggtggacccaggaggcgtcactcactcagtgcatatttaagcagggccgactgtgcaccaggaacgattgtagtctctggccacagcaaagaacaaaacaaagacccctggcttcagggagctcacgacccacagagggacagaggacaagcaggtgacagcccaagacagtgcacaaagcagaagctggtggtgccgcctgggtcccgcaggcctcagagtctttgccctgcgatggcttcttgctgcccctgctctcctgcggctcctcctcaggctgcaggagcctgtgtggcctgggagtggagtcctgggaagctgccctgggtgaacggaagctggcggggagcagacctggcttccccgcctctccagtgcagtcctctgatgctgctcctaagcgtctccatgaggtctccagtgcagctgagcaccagcagcccaccgtgggcacctcctacttatcccaccagaaagggcattttttccttcccatttccctccccaccgtcttgcccgagcttcctggggacttctccaggtgaactgagtcatgcccactctcagagtcagcttccagaagaatccaaccgaaggccatgtgtgacacgcaaactatgtcagatggtgggaagtgcactggaaaaagacaaagctgggaagggagggggtggtggttggggggctgtgattgctcatggacatctgaggagccccccaagaagggggccttgcagcagctgcccaggcggtgagggctcagcgggtggatgtcccggagaggagcatcccagggcggccaggactaagggtaagatcccgaggtggggagctcctggcctgtcctaggaagaccaagaggccatgtgaccagagcaaggggacacaggagagaagcaggaaagagaccagcaggtggaaggcaccagaggctcagggccctgttgaccagggaaaggctgtggctgacagagtgaggctgcagacctgggctcggtgcagggcatggctaatctgaatcattgaatagaatagactgtggtggaggctaggcagggagaccagggaggcccatggtgtgatcatccttcgagagcagccaggcaggagcaggcaggtgggcggagtgcaggaatcagtccatgtggacagcagagggatggaggtgctgagcggtcagagggtgggtgccaggaggggagaggagctggccatgtcggcctgagcacctgggcaggaatagccaccatcacggaggtggtgggggtgaattgaggaggtggagaggaaaacccatgactatttgagttggagagagcccaaccacagctgaatgcatgaacctggacatcagctaaaggtctgggctggacagagaagtaaacatttaaaaataaaaatcaaatcaggtcaaaatccccaaaatatgtcacatgatccttttcaatcttggaccccccatctgtggaatacatagacttgtgatgcaaactaggagccagatgaggacctatgctgttggagctggactacatggatcccccaccatagccccacaccaacccattgctcttgccccgggctggggtctccagaagcagaaactgagatggagttttcagttcaaaatacttctaaggaccaacacttgtgaaaggtacttggtggggaaaggcacgctgggcaggggagaagttgatcttcaaggcaggcctgacgtggcctccacaaatttgcagaggttctgaaacaaatattgcttgtaggagtcaacccatgttgggcccaaattaccaggcttttattccctgacttccccagccaccaggagtgagctgtcctggaaaggtcatgaccatggacaggagggctctctatagctttatcccttatatatataaaaaaaaattgcaagaaaatctaagatattacaattataatctagggaggttgataagactttacaaaccaagatggataatcttgatatttaaaaaaccgaaaataaaaaaatttgaaaattttgtacataaaatgattaaacaagctatataaacctgtatttgtaagtgaatactagacaaggagctaatttctgtaatatacaaattcttacaaattgacaagaaaaggaggtgatagctataaagaggtaattcacagaaaagcatctctctgctcttgaactgctagaaatgcaaactgtaaaaataaaagtacccaaaccttatcctaaaatgcacagatgtttactgcaagtgttgtttatagcttcccagaactggaaacaaaacacattcccattatgagaaaaatggctgagcattttgcatgtatagccacccaatggaatttccacagctattgtaaagaacaactttaatttagagccatataagatgtcttgaaggtatatcaacaaggagttaagtgataaaatcaagatgtagaaaaatgttagttatgggtctgtcaatcctggtgatctctttaaggagctaacttttatctttgttaatcttatctattgcctttcatgtactatttcgtttacttctgctcttccctttacctacatatttcatagatacgtatcgacgtattcattgtacatatctacgtattaattctacatacttctggtttacttttttttctagtgtcttgaggtagaatcttaggtcactgattttttacctttcttttttgttatattacattacattacctttaaagatataattctttccctctgcaccgctttagctgtggcccccaaattttgatgttgtatcttatcatttggcaaaattccctcttaagttcatttggactaaacactggaatgatttagaacaaaatatgaagcaaaccatagttcaactggtgcacaaatttagccaaaagatcctccctccatagcgaaggtgagaggatcgcttgagcccgggagttcgaaaccagcctgggcaacatggtgagaccctgtctttacaaaagaaaaacagaagttattgaggtttgtaacttgatattgtggcattagttggaaaagccattttacttcaaaactggttaaagaggttaaaaaaatattctatctgtcaggagtgaaactgaaagctaattgagaatcccagttgagatcttggaattttgtttgtgtgctttacttggaattgtccaccttatgtgcttacaatgactgggtgtctcccattatctgtacagctttcccttagtaatagaacccctgttaattagcagtttagctggtgcatggcagcccagaagaaggacggccgtttccagcctttcttgcagcgatgtgtggtcaggtgagtaagtgctgcccagtggaatgtgagtgcaagagtggcgcccctgccaagttgtgcccaaggaggaaagggtgtgcccagctcttttctcacttctcactggctgaaatgcagacaggggtggggcatctggaccaagtgaaggaagccaatggcctagggatagcagagcaaaaagacagagggaaacggggtccctcaaaacttcacaaactggaactggcacaccagctcagctgttgacatgagtgagaaatgcacttccagcttgtataagccactgtctctaccacagtagccaaagctaaatcccaatggatccagagcccagagacaccaagtgatgacctatggatattctgatctggtctgtggagactgggtttctctgggtattttctacacaatcaaactcaattgaggataaatatgcaggttttagagccgttaaacataaactgggccagaaatagaaggagctgattttgtgggtggaaaaaatgagtcctaaacagatggaatgaattactcaccaaaattagaagcatgtttcctacaatttgcatattaatggtctatcccaaacacaaagtgaaggaccacaggccacatctggctagaggatgtgatcagcccacagcactcgggtctgtacagtttgttttcaacatttaaaaatgaggccaggtgcagtggctcatgccataatctcaatactttgggaggccaaggcaggaggaacacttgagcccaggagtttgagaccagcctgggcaacatggtgagatcctgtctctacaaaaaaaaaaaaattaaaaatgatctgggaatcgtggcgtgtttctgtagtcccagctgctactcaggatgctgaggtgggaggatcgcttgagcctggaaggtcaaggctgcagtgagtggtgatcacatcactgtactccagcctgggtgagagtgagaccttgtctcaaaaaaaaattttatattaaaatatagatttccatcttcctctgaaaaatcaaagacacagcaaacttgtgccctttttactgggtgactcatggcctgaggatgtcacagccacctcattgcaccggccagtgagcctagacttgccacagtgctcaccacctgctgtccctcaacagagaaggcgagagtcatcactacttattacctctcatgctgctggcctttatttccattcatgaaaacaaatctttctacccacctctctattataaaaataaatagatggagagcatccatcaacagatgattggataaagaaaatgtggcatatatactttctgccatagtattcctaaatgtgaaaaatatacacatatatatattcacagaatagaacatagggtaggaatactacattctatgaataggaatagcattcaatagaataggaatactattctgacataaaaaagaatgaaattggccaggcgcggtggctgacacctgtaatcccagcactttgggaggccgaggtgggcagatcacaaggtcaggagtttgagaccagcctgaccaacatggtgaaaccccgtctctactaaagatacaaaaaataagccaggcatggtggcacacacctgtaatcccagttactcaggaggctgaggcagaagaatcgcttgaacctgggaggcagaggttgcagtgagctgagatagcaccattgcactccagcttgggtgaaagggcgagactccatctcaaaaaaaaaaaaaaaaagaatgaaattatgtcttttgcagcaacatggatggaaccagaggccatttaccttaagttaaataactcagaaagtcaaaactgcatgttctcacttataagtgggacctaaattatgtgtgcatgtggatatagagtgtggaataatagacattggagactccaaagggtgggagggctacagcagggttacggatgagaaattccttaatgggtacaatgtacattagtggagcgatgatgacactaaaagcccaagcttcagcactatgtggcatatccacattaacaaaaccgtactcctgcccctttgatttatacaaataaactcttcaaccacaccttggtgattgagccatttgtgtcctgccatttgttctctgacaggtacacctggctatttgtttcctttcatagtcattattatgacctgaagtactggagaatgtcatcaaatctaagatgccagcaactataagatgcaccattattttacacactgctgagaagggaaaaacactgacaaactgcaacacaatgacactattaagatgcactccaattttaaatattaaaatgtgcaacaaatggtgtatttccaaatcaacaaaatatattatgaattgtgttttttgtctacctcctccccaggagtgtaagctccctgagggcagggaggttgtctgatttcttccctgttgcatcccaatgtttggctcatggtaggggctcaagagatactttttggatgaaagaataacatccagccctccatgagcactcctgctcctcagggtgtaaccctggcacacagcatgctgagccatggtagagcacttaccactttcctatgatgatttggaaatgtcctgtcatcctctttcaccaccgaaccttccaggaccgactccatcttctctcccagcctgagccagaggctcgaatgaaggtggggacttccaagcttcactctcaaggtctccgagagctttgcccttccctagccccaacgctattgctggttaactttcctgcagtctcagacacctgggagccaaagtcttatggaaacaaaatggaaatgtacataagagcccttggggatttgcagaggcaacattcccaaggcttaatcacatggaattgttcatatagagcttcttccagcttgatgtgaagggatttaaaccccttccttcaattttatttcccagcctgctgtggggatgtgtgtaattcttatctccgtcacagttaatcaagcgcccatactaaggagataacgtcccttccctccgcacctgacttagggaattaaacggctgcatatctgttgctccaactgcatggaagtccacagtcctccccaaacctcacctcgagcttttcaagtaatggatttcgataagggcataataatcaccatcttctttcagtttaaaaatgcagtgctgggtaaaataatgtttctagtaagagcagaaaacatgggaatatcgtggataaagtgcagacagaaattggcgataagggaggtggggagatgggaagctctgggtgaagatgaagatggggacagggtggggatgaggtcctggagtgcgggtaataaggaaacctaaagctgccaacataattaagactgcccgagccaggagacacacggggcattttttaaggatgtaaggtgtgagaggtcattaaactaagttaccagagcttccaagagacaaggagagtaattgaatgagaggccctgacattgcagaaagtctaaattaattcttttcttggctgctcatgcaggatgaaaaagcagttaccagaaataaaagataaccaaaatatttttgaacatacacaaaatgagtgtgtgaggggggagtataactatatacctacggagagaagagaaagaagtggagaaatgaggggggcagggaaagaaaccctaataaagggaattgaaaaaatcattcattttttgatgttacagtgggagtttctgtgacacaaatatacttgaaaagctgcctttgacctgccttttgagccatagttgatacttacctcatgcagggcaggtaagccccacagtggggcttagttcaggagggttcttggctttgtgcaagaaagaattcaagggcaaaccggaggcagaagaaaacagctttattagagagccagtattactgctctgtgaccgctcctgcagagcagggctaccgcataggcagagaggagcagctcagagcagttttgcagtcatatttatacccacttttgtttttgtttttgtttttgtttgagacagagtctcgctctgttgcccaggctgcagttcagtaggccatctcagctcactgcaacctctgcctcctgggttcaagtgattctcctgcctcagccacctgagtagctgggattacaggtgtgcaccaccacactcagctaatttttatatttttagtagagatggggttttgccacgttggccaggctagtcttggagtcctggcctcaagtgatccacctccctcggcctcccaaagggctgtgattacaggtgtgagccaccatgcccggccttatacctacttttaaaaacattcttctagggaaaggagagtaacttttgggtattcacgtcattgccatggaaaggggtattaactcccgggtgttgccatggcaatggtaaactgacatggcacactggtgggcatgtctgatgaaaagctgcttccacccaagctctgttttagcaagcacagattttggtccagtgtctgagccccacctctggagttgagtcccgcctcctacctcacacttccaggtcccaggctttgcaggaaccacagcagccccttagagctgtcagggagccagggccaaggccgcattgcccattctttgtcctgtgaatcctacatcctcactgcctgcacagatgtccccaaatccccactccagggtgagcgcaatacattccaacaccactgcctgctctcttctactcagagcttcacgaatcccagagtgtgaaatctttgcacaaaccaaacatggcactcggtaacattacatcctatacagtctctcttggttcttccaattacctcaaagaaaacatcttgatttggtgctgatgtgcctctcccacctctccaagcccagcttttcatcctttccaacaaagaaagagaagcccccaggcttactgcagaatatggcacctctgcttaagtttactgtttttatttttacagttaccttccttcccagcaagagatgctggtttcacatttactctggatgatttaagtgtttctttcaaataaaagttttttagtgaaaaaaaaatgggtttatttaaagaaagctatcagagatcagcaaactacagccctgaggccaactgcctatttttgtaaatcaagttttcctgggacaccgcagtgctgatctgtgtataaatcgtctctggctatggctgcctggcattatgacagcaaagcagggcacttgcaacagaggccatgtgtcccacaaagcccaaaatattcactctctggcacttgccagaaaatgtttggccaccccaggagcaaaggatcatcctggggaaagtggagacagtggcaggtgaatgatttaaattgagtaaatagggaaccctggttaggagcttggaccccagggtgagacagcacaaggtgaaccccaactcccctatagaccattgagtcccttctcgtggaggatcctaggctccctcatctgtaaagtgggagaacaggccccacatgaggctcttgtgcagactggtgagatactgcgtgcaaggcataggtctgtgcctgccgcaaggtagacagccagtaagtggccaccttgagtattaccagggcaggaggtgagaaaatccatttatcaccagctgagataagagttgcccagagaagaactattcagacttgagtagggatgtgaagttgaggtcaaaggcaggaggtagaaagggatggggttgctaagcaacacatccagatgctggaggtggcagaagtggccaagggaccagggcacagataaaattacccacctgtgttgctccaacgtcaccagtaaaatctgtccgtcacagctgccaggaacatggaatttgagaagactaataacaaggaaaggccaggactggtggctcatgcctatagagcttcaagaggccaaggtgggatgattgcttgaggccaggagttcaagaccagtgccaacaaaaagattgaaactctgtaaaatatttgaagagatttattctgagccaaatatgagtgaccatattaggggctcatgacacagccccaggagatcctagaacatgtgcccaaggtgttgggctatggcttggttttatatgtttaagggagacataagacatcaatcaatacaggtaagatatatattggtttggtcaggaaaggtgggacaactcgaagggtgcgaggggtggggcttccaggtcataggtggattcaaagattttctgattggcaattggttgaaagtgctaacttattacctaaagtcctggaatcaatagaagggagtgtctgggttaagataaggggttatggagaccaaggttttatcatacagatgaagcctccaggagcagccttcagagctctaatcaggcctaaaaaggtctcttttttagactcttagttaattctctcccaggtcaggaattaggcctggaaagggaaagagattctctacagaatgtagatttttcccaccagagacagctttgcagggccatttcaaaataggtccaattaatatattttagggtaaaatacttggatttctttcagaacctgctgtcattttgtgatgtgtcacaatgctacaaagagtcatttgtcagcctttaggtctctgccttaatgttaatgctggtcagctgtgcctcaattccaacaagaggaaggcataagccattcccatcgtgccctgcactctcgttccaggtttactttggaatgccctttgctgagaggagggatccattcacttggttgagggcctcagaattttattttttggtttacaccagtctgggcaacacagtgagaatctgtctctacaaaaaaaattttttaaaaattagcagggcatggtggcacacacctgtagtctcagctactcaggaggctgaagcgagaggatcgcttgagcccaggagttcaaggctgcagcaagctatgattgcaccactgcactccagcctgggtgacggcaagaccctgactctaaggaaacaaaaacaaaaaaaaaaaatacaaggaggagcccacaccatgcttggatgtgtcaaccttaaataatgagtttcagaaattatgactaactatagtgtttgagctcgaagcttgaggatgaccacccggaagcatagatccaatttgccctgaacatgcaagataattagccagagttacaagtgggtttttaaggaaaaaagaagaggcactttctaagttgttcaccaagaatttgcattaaaataacacagaccattgactggctacacattgttctttgtatcacaaactccaggaacatcaagataatcgggaaggcagctagtcatgactaaaacgcctttaaactcttgctcctgggcatggggccagaggggtgactgaagtttcatactcatgtctccctggacctgataccttctgcatacctaacatagctcagatttctctgggctattttttttcccaagatgaatggactcctgcagaaacaagacgggcagctacaagaaacaatgtggagagttaagagctcagcagaggccagaaacgagagctgggaggagcaggaaaaaatgtcagcttcatgctgcggaaatcttgaggatagctatggacatttggacagtctacatttgggattcaaacacccaggttatgatgagattctgtggtcctttcaagctggaattgttggtgacctgaacaaatttattgtgaaaataacaggaacaggtaagccagtcaggaccctcaggccatagatacacagacaggggatgtgtcctgcattccatgaacacaggggttctgacctcagctgttcatctctccacgaatctgctttttccttgagcttgtgtgagattacgcccgtatttgtcagtgttaccatcatttgacctggatatgccacaaaagccaaagactattatttggaacttgggtttggggtaaatatttaccttgttaccaaattcctccctttggtccccacttcttcctgagtcatgcctgaggcagtccctttctggaaccctccagttatctgcaccaataaatccttttttcccctcagactgtggggttgggttttccatcgttcagcaaatgaacaattcccaatttatagaaaccagagaaggtaggtacaattaccctcccaatgttactgaaccaaagctgggtctgctcacctggtgcagcaaagccaagcactgacactgaggtttgtagcaagagaaacaaggctttaaggtagggcaccagcaaggagaatcaggcagctgatgcttgagatgcaaacttcttaggggcttataaggaagggtttttaaaggcaggggtaagtttcaggaaaggagaagttgccagcaaaatcataaaccaatacatggatgttacatattggtctacctttaaaaaggcaggatattttggattgggggcttgaaggtcacaggtggattcagagattctttgatttgcaatggatttaaaaaacaaggtttgtctaaaatacttagggtcagctgaaaggaatgttaaggtttggcctataggtgtgactctctacaggcccctcaggaagagatttagaacaaaattgggggtcaggttcagtcccagttcccctttatctgaggtctgcatgaaaacagtcagcattttccatctggtggggtcctagctcctgaaaaacaactcactcaaggacatgggtcaagatgttctcttttactttctatagggaactgggatggttgagtgtcaacttgattggattaaaggatacaaagtattgtttctgggtgtgtctgtgagagtgttgccaaaggagattaacatttgagtcagtggactaggaaaggcagacccaccctcaatctggctgggtaccatctaatcagctgccagtgcagctagaatgtaagcaggcagaagaacacggaccgactaggcttgctgagtcttccagccttcatctttccgctggatgcttcctgcactcaaacatcagactccaagttcttcagcttttgcactcttggacttacaccaagagtttgccaacggctctagggccttcagccacagaccgaagtctgcaatgtcggcttccctgcttttgaggttttgggacttggactggcttccttgctcctcagcttgcagatgacctattgtgggacttcaccttgtgattgtgtgagtcaatactcattaataaattccctttcgtatatacatcaatcctatcagttctttccctctagggaaccctaatacaggaacctaacatcttgtgactctggcttacttgggtggcttttattattaccttcttgcttagcaggtgacatggtttggatctgtgtccctgtccaaatctcacgtggaattgtaatccccgatgttggaggtgaggcctgaagggaggcgactggatcatgggagcggtttctcatggatgggttaacagcatcctcttggtgctgctcgtgatagagctcgtgaaatccggttgtttaaaaatgtgtagcacccactcccccttctctttctcctgctcaaccatgtgaagtgcgggctccccctttgccttccgccatgattgtgagccccctaaggcctccccagaagcagatgctgccatgcttcctgtacagtctgtggaagcatgagccaactaaacctcctgtctttataaattgcccagtctcaggtatttctctacagcagtgcaagaatggactaatatagcaggttattcatttacttccctaattgctggctgcagaactagttaggtgcttggaatcttccttgaagggactcaaattttttcctttatctttatgtgggtgggtgttgcgggggggtgggggggagcctggcagacctctaaaaggggtccctgctccatctcacccgttatacagacaaagacactgagggtacttccaccttacaccctgccacgcctggattgcccacctctgttctctcccagccaaagcaaagagaaaaagagataatgctcacaccccattggccatgtttttgtcacaaggaggcctggaaaatgtagtctttattccaggaagccaggctccctgctaccaggaggaatgctgaggtcatccagcagtctctgccatagctgggtaacccccacctgtccctgtcccccatggggcaactttgagtgcaggacagaggacccacaagcctcacaccaacctggcaggacatcttcatcacatagcctggccaggtcatccccagaggaggacagcactggggtctgggcagaaccaaggctctggacaggccagaggggaaaggcgtaagcaatgaagggagcaatatccacaaaggccccacacctttcctgggtgctgctggcttcttcccacaccagacatctgagacagaggctgcggtgagaggatctcatggtcagtcactcttgcattggatgggaaactcccacctttgaatgaaatgctaattatagcctccatgtacagtctgttacctgctaaaaatacgctgtcttattctagtctctgcaggtgcagccgagttgggggaaataatgctgtttttagcatgagtacaaggagacaaccgaatcctagactcttggggacagcgtctgtctgtctgggaacttgtttccaggagtgtgaccgatgtgaagggccaggcagaggaagtgctgcaaccccaggggcacaacagagcagagctaactgtgggaggaagcgtcttccaggctcaggctcgcagtggaggcagcctcagcttccagggctgacagacattcgtcatctcggcaggagggagactgttaaaacaggcactgagggagtgcaatggggccccccaatccatccaagaaagcccgaaaacagggatgttggaatgagatggggaggagaaggtcccaaagacagtagaggaggcaggtatggggaaggattgagagatatcatttgttcattcatttattctacaaatatttattgagtcctactatgcaccaggcactctgctaagttctgggttaaagtgacagataaggtcgctgccctcatttattaaaatatatttcaacatatatggagtcaggaactgacctaggcactggagacacacagtaaagaaaaacccctccctcttggagcttgaattctaattagggagggagagtctgatgttcctttcccaagaacaaattgtatatgtccgttttcgctctgctgataaagacataccctagactgggtaatttaaacaagaaaaagggtctcatggacttccagttccacgtggctggggaggcctcacgatcatggcagagggcaaggaggagcaagtcacatattacatggatggcagcaggcaaagagagagagcttgtgcagggaaacttccatttttaaaaccatcaaagctcatgaaacccattcactatcacaggaagagtgcaggaaagacctgccccataattcagtcacctcccaccaggttcctcccacaacacatgggaattgtgggagttacaattcaagataagacttgggtggggacatagccaaaccatatcacaaaccaacaaggaaaggatgacaagagctggggacttccatgggaccctcccatccttgtccctgggtctccagttcagccttccaggtccaggaggtattggctttcccacctggccacatctgctgctcagtttctctcttgtgcccttcgaaggttcaaaccagcaccctcagccctgatattccccctcactctggggacatgaccacagggtccaagcaagccagacggcaggggaagcttcacctcacttccaccttccggatctagataagaggatccagttggcagagccaaattcacatacagacccaagttgcgtgagattttgggaaatgccatttttaacatccaggctctactcaggaagcaaagaaaggagggcagtggagcaggtggccaggccaggtgggactacccctgctactcaccacccaggctcgcccctccacccactcctgaacttccaaacacaacatttcctctgcctactcccgtgatcctgtgcaaaggacaacaccccctgcccagggaggccagagtccaccagtgctaagaaatgggccaagagtgggaggaacagccgtcttcctgccccaggaaactcgacattggctgcagcttgagaggggtccatggtgccagaggcccctgcatcccctgagactggctcctcctacccctgcagagatgccccagaccagagaaactggcccctgcccctatgtgcaatgacccctggggcatcacctgtgaatgagcccacaggaggaaggtcacagccagcactcaggctttagaagggtccgacctagaatcgatgacaccctaaatggagggtcagaagagggttcccccagttataaattcctcaaagcttcaaagagggccgtttccctgcaagctgagtattgaggctgctgctgggttctatatggtcagaagggggtacgctgctgtggagacagacatgctgtatagacatcacacccacaacctgcaaaagttcacacagcaggatgctgcacaaagtcaccaaatgcaaagttcacctggcatgaatattcaattgcctgctcctggaaatggtgtttctatctttatcgctcacgggcagaattgctgtggagtttctcatatcactgacattgacctctggtgggccagtcaggtgatagcctcagaaggctgctccagcccagctgggacggatccgtctccacagcacgggatgtttgcttgaattcgactaatacctactctcaggaaggaccatctttgctgtcagctctggttttatgatctcctgtgaaagggaagacatgtctccatccagggtcaaggctccaagcccttcattctcacccacaggtggatcccagtgtaacaggaagttgaacatcattccccactggagttggagacccagacaccccctgcagctccacaggtgcggggaaatcaggtgcctctgccttttcctggtggggtcagggactggagtctggaataagagagtgggaggtcaccgaggggaagatggcatctggggagaggaaacacctgggagaagctatttgcattttgtcatttcagaagccagatgttggaatgcaaagaaattctactcacagtaacacagtgagaacattttcacaaacagttttccacggatgtgaacaggttagaaccctgagctttctagagcacagcctccggaggcagattctctgggttcaaatcccagtccactgtttactagctgtgtgaccttgggcaggttacttaacctctctgtgcctgagtgtcctcatctgtaaactgaggataatgatagttcctgttacataggattattggacaagttaaggcaaacaatatcagcaaagtgctcagtgcaccatctgcctatgggaggcaagggtttaaaatgttaggcatcatcaccctcatttggttgcactgaatttcatgttgattattggctttatattattactgatgttttatattgattattggctttatattgattacttctgattattactgattggttttatattgagtattatatggcatctgataacattctcatgaccttcattcttcattcctggccctacagcatcatgtgtttttcatgctgggatcaattccattcccttcatccgacctttccctgcagaaacacagccagggaaaggagctctgaggttatcccccatctttaccacaatcagcagccacggatgtccctgagagcccagagcaggtgctggcccatcgtccctcagaaggtggcactctacgctctacagaacatgtgcttcccattccaccttccagcatctgctaatcctggatggctgcccagccttgccctggcctcccttcctgctcatgagcatccccttccccacacagcagttagaggaatccttctcatgctgaatcagctccaggcacctctctgaccacaaccctccagtgcccccatcacaggacagactgatcaggtcctgcctcctctcagttcccatctctgcccaggctcccctcacacttgccctcggtcactccagcctcactgcagtgtcctactctccacctcagcttgtcccaccttaggtccttctatcaagagtgaccgtccctgaatatgcccaccctcaactggctcctcctcgttacgaagatcaagcggcaccacctcaaaagccctcccgacaccccagtccaacatcagccaccccctcccatctgttaggtcactctcccctcctggaatgtaagtcccaagaggacagggatgctggcagtgctggccactgctgcatccccagcacccagcgcccaggacccagtaggtactcagtgacatttgtggggcacgtgatgaatcaaagtggcctgggactgcaggtgggagcagcgccccctcggcagcatggggggttgtaataataatgtcacctgtgtttacagcctgcttcacaacctgcagaacttaagcacccaccatccctgaaagagaaagataaacacaaatccagacgtttagccagaaaatgaagggaagacggaaaggtttaaaaatgagcgagagcatatgtttcttcctggcttcaagataaaagaggatacccagaggagaaaagcactcaaaaaacatgatgctttattcaaaaattagcccacagcagagtgtcagggaatctgtagtaacgaagactctgggataaattcttttaaattaagaagcagaaggagaaaaggcagcagccctgagcctcgactttggaatgtcctccatccatctgcatctgtcatcagctggcagagcgggtgcatggcagggggagccagggccaccattcctcccttcagccctttctgctctcagtttagggataaccaatgtttgatggcttgtctctcaagagtgattagaagcaaagctgcccattacaggctaaatatcaaagcgttcctacagaaatctcacttcctaagctcaaagccctgattctgggctgcctcttgacccaactcatctgggaccctgactggcaccagcagacgacaatgggctgacacacaccgtgcttactttagaccggggagtgcagttctgagctctccgggtgtgtgaacttacttaatcatcacctgaactcaacgatgctattgggattcagctcacagatgaacagagccaggctgggcagaatcaatgctccctgggcccatggctgcaggacagcagagccacttccaggacccccggccagcacaaggcccacaccactgaccactgacggtgctctgtgatggaagaggggcctcagcgacagccccagataccaatattgctccaagtgcctctttccaggaaacagtcctcttctgagacagtgaatccagcataacaggacagtgaacagacttttccagagctctcagaatcatggctgcagttctacagcttcaaagcgagtgtgcaaacatccacaagagtccctggcctccaccccaacaagagagagacattggaaaggtgattcctgggagggtgtgtgataagagtttggatattggacccctccaaatcccacgctgaagtggggtccccaaagttggagttggggcctaaagggaggtgtttgggtcatggggcagctgcctcatgaagagcttcataccctccccatggtaatggcttcttagtctatgagttcctgtgagaaatgactagttaaaaaagcctggcacccctctcctctcaccacgtgatctgcatacaccagctcccttcccatgccatgagtgcaagcagcctgaggcctcaccagaagcagacgctggcaccatgcttcctgtatagcctgtagaaccatgagccaaacaaacctctttatcaattacccagcttcaggtattcctttatagcagcataaatggactaagacagagtcttaaatcagtttgggctgctataacaaaatattattgaccaggtggcttaaacaacaaaaatttatgtcccacagctctagaggctgggaagcccaagatcgaggcaccagcaaattcaatgtctggtgtgggcctgcttcctggctcacttatggcaccttcttgctacatccttacagggcaaaaatgggagaacaagctcacattctcctttcctaagataacttcagtgttgtcaaggggttcacctcttcccatgcaacccctgtggcctaggatcctccactccagggtgattctgttcagtctgagcctgttcgcatacggcatatgcccctgctgattggtatttgcccagggctgggggcaggtatgccaaaataggccaaatacactaaaggaaaggacttgtagtgcatgctttgggggagtttttctcctgtctttacccaatgggcctgcacatactgccatgtggcctcacacgctggtggcagcggtcttgtgacgaggaggtgaaccaacctcagaacatagccaatagagtgagcagcaaagcggaggccaattaaccctggatctctgcggacatcgtaaagctgctgaatcaacctccccagaggtccagctcctggctggtctttgaactgggagataacaagttcccttaccatgttagagtcattagaggtttcagttacttgcaggcaaaaagcaagctaatcgacacagcatcttttccaaaaatccttctctgatccccccagcaaccagcaattccccccttctcggagcctcagggacttttctcaccagactaacccgctgtatcgtgtgtgccatttatgtcgtatcgcccccatgagccatgggcccaaggagaataagatctaagtcatttctctcctcctgagcccagggccttacacttaacaggggctttgtaaatgtcatggcacaaatgaaagaataatttagaagccaggtatctccactttagatttatgtaaagaaacacattactgttacttcaactgctctttcagactgtatggaagtatttttatgtcagtagagatgaatgttaagatgttttgttgtaataaactgcatgtccataaacgccctatccctcttttcccccagtcaacagcatctgaagactcagcaactttcttccagcaaatgatgtccctctttaaagttcacactctctttaacagatgtagaaattccaacaaacacatctggacaggtggttaccaagataactctccaaaataggtccaaaatgggactcggggccaccagtgagattttcaacaattcatccccccatgaactgtgagggccacccatccttatcacaaataaaccttgacatcccaggatacgacgcaggctgggccttgcaaagaggaaatacagactcccttgggtgacctcagaataggatttcaggaaggggagtggtggtcgtgctgtaaggtcagagtggacctgatcttacggaggctgtggaaaccaagagcaggaacccccaacatccagcttgggaccatggcacaccactgcacgtttctgaaatctcatctccccgaaagcctacccctctcaccatcttacttaccatagtgatgtaggccagggaagctccaaagtggagcttagcctgagagggttcttggctttgcccaggaaagaattcaagggcaagccagaggtagaagaaaacagctttattgtagcagcagtgttacagctgaagtattacagctctgtgactgcttctgcagagcggggctaccccataggcagagagtagcagctcaggacagttttgcagtcacattcatacccacctttaattgcacacaagttaaggggcagtttacgcagaaattttgggggaaggggtagtaacctttggatcaccgagtcattgccatggaaaggggcagtaactctcaggtgttatggcaacagtaagttgacatggcacactggtgggggtgtgtctgatagaaagctacttttgccctggccctgtttcagctagtccccaatttgatctggtgtctgagccctgcctctcgagttgagtcctgtctcctacctcaatagtaaacggcaactcagcccttccagtggtctagccacctctttcacctccaccatgaataccacagcccaggcatccatcacctcacaccagaccgcagcagtgcctcctctctcatctccccaactccactcctgttctccatgcagttcattcttcacacacagccagaggtactcgctaccaaatcctctgtccaaaacccctgggcatgtcccatctcatcagaacacaatccaaaattccgtatcgtgtagagtgaacgacttgtcccagctttctgaagactgccccagttgtatcactcaaagtcctgtgtcctggcaaacctcagtccaggcaaaccaggagggttggtcaccccaggatcacaacattcaaggcccccacataactcagaccatcctcccccttgctcactccactacagtggccacacaggcattcttgttcattctagaacatgccaggcacactcctaccacatggagggcctctgcaccggctgttccctccaactggagcatgcttcccccagatgtgcacctgaaagactcctttgattcctccaagcctgtgctcaaatggcacacttcagagaggacttccacgcccccatgatctaaagtaaagtaggccctagacacttgattgaaaagccctgctttattgcttgttttttatggcatctattactacctagaatagcacacatactcatatatgtatgtacatgtttgtgtggcatatgtgcatgcacatgtatgtctatgtgactgtatctgtggtggggcaggctgtgcctattgttcactgcccctgaactcccctggaacatcagctcccggaaaacggccctggtctgtttcatccacagctgcatcgctggtgcctagagcgtgcctgacacgtaggagctgctctgtaaagagcagatgaatgaatgaacggtacactcttctgaaagtgttgcctccatggagaactcagggagacagacacaagctgcctggcccagggtatctgaacccagcggctggactccttgtccagtgttccttcagggtaagagctaaggttgcatttgtgtttttcttctcagcccagaggacctttttgcaattttctggccatgggaaccatcgcagaagccagtcaccaagcttggcctcggtgaacatgctctcctagaacgagcctcagaccttcggatctgcccatctccaacaacccagttcctggacagtcaccccaggcagctcccctatccattaggacagagctagacaattagggtgtagagcttggtgaatcctgagggctcatctcaggccacccccgctctagtgaggaacctgcaggcagaggagggacatgactggccactgagagcgttgcaggcagagtcggcaagaccagctttctcccaccgcagagcactttctcgatggaagattctaggagtctttacccaattccattctctcacccttcttgcaagtcagcagggcagagacaggggcagcagagccccacttggcaaacaaagaagctgaggcacagccaaggtcagtgactcacctttcttcaaagagctaattactgtggggccccagcaagatggttacagtgtgggccctgagtcgtggcctgggctaggtcctggctctgccactttcaagctgagcaaattgctcacccctgtgtgcctcagtttctccatctatagaactggtaataagcgtaattgacctgtggcttttacgagcacaatgaaacccaggcatcaccaatgggaggagcccagccctggaggcagatgccagttccaccccacccgcccctccacccacaggctctgaggctcccccgacccctttgcagatggaaataatggcagcacctctggcacaaggcagttgtgagaactgatggtgatgtttcactggtttctttcaatgcttcttgttttgttttggaaaacaaccagagcagtgcctccacacagcaagcgcaatataagtatttgttaaataaaaatatggagaacacacgtatagtgcttaggccaatgtctgatgtaagtgatgcttttagtgacaaggaccagagcgtgagtcatcctgaccctcctgcttccctcccgtccatgataacccccaggccacatctcagactcacggggccacttgaatgccatttcttctcagaggtgaccttgctctctctgcttccatatgccactgcccacctcctccagacaccctgtctcccacacacacacacacactcacacacacatgctcacacacatcatgcacattcacacgtacagactcacacactcatactcactcattcaaatgtatacagttacacaccctcacacatgaacatagtcaaaaacacacacatacacactcacacagactcacacacatgaagcctctggggtacgtgcaaccaaagctctaaactaaggttctgaatcccagccaacattgcaagctccacactgggcctcctccaagcccccatccctgcccaaatacccagttcccgcactgccaggactcaccgacgcctcagcagagcgtggactgtccccttgatttaggcagcacctgccacctgataacagagcgtagcctgtgatggcattaaacacttcaaagatcaagttattatttataattatatatatgcttattttaacagtaactcatctacttaattggaatataaactggaaaataaaataatgttataaattcctgctaggcgctgttttcttctgaaggccctgagccagaggcctgttaaaaagaaagatcgcgttttggagaaatgttaaagacatagtgcgtgaacttgagacttccctcaaggaaggagagttaaaagaaaggggggtttgaagggccaccttcctcacgatgtgtctccgcgttacacagtgagtgtctgtgtgattttgctggagtgacgttccgtgtcatcctcgatcgtggaaaaccttctgccctacccacatcctcaaacacttcactgggctcaagcccccttacgcctgctgatgtctgcatctcttgcttgagggcttcttccagaacacaaggtggccattcttccagcacacacatgcgcgcacacacacacatacacacaaacatatgcacacacacacacacacacacacacagcaagctggaaatcacagggaataaaaaaacccaccactatcaccaccaccagcaacttccaaccaatgagtcctgagagttggagcataaataacccaggcctccggacctgcaggcggggcaactctgccctgtggctcatgctgtctgcagctctccgtaggatgaagctcccacggccctctgcagtagcccacttagtaacgcaccctctcacaacctcttggttctttgctttctgttgcatttcccctctttcccaacttctggtaaaggaataatttgcactcaaatccttgtctcgggaactcaaacaaatacatgtatacacatgttcacagcagcattactcacaataaccaaaaagtagaaacagcccaggcgtccatcagcagatgaacggagaaccaaactgtgatctatccacgggatgaaatgttattcagccctaaaaatgaatggggttctgatccatgctgcaacatggatgaaccttgaaaacacgatgctaagtccttgaaaggagccacacataaaagctcacatgatcccattcatgcaaaaggttcagaataggtaaaatccatagagacagaacgcagctcaggggctggaggatgggaaatgggagcaacgggtttgggtttcatggttataggtgatacaaaatattttgaaactagatagaggtggttgttgtacaacattgtgaatgtactaaatgccattttgttcactttaaatggttaattttaggccaggaaaggtggctcacacctgtaatgccagcactttgggaggccgaggcgggcagatcacttgaggttaggagttcaggaccagcctggccaacatggcaaaaccccatctctattaaaaatacaaaaattaaccagctgtggtggtgcatgcctgtaatctcagctactcggcaagctgaggcaggagaatggcttgaacccaggaggcggaggttgcagtgagccgagatggcaccactgcactccagcctgggcagaagagattctgtctcaaaaaaaaaaaaaaattaaaaaaaggttaattttaggttttgtgaatttcacctcgattttaaaaatttcttatctcagggtctgcttctggggggtccaaactaagttacctggcaccatgggcggcaacccatgcgagggactgcgccgcctctaatgataagatatggggagccaggagccctgcgtgacctccctcttctggggaggttcttggtctgatccactgctttttcctgagatcagaactttcaaatctaccttgtgaagtctagaaaagcacatcttttacagagtgggattaggaaactggtcataatctcactgtcctcaaaaagagcactttttcacaaacaggctgagaggtctccccagcttttctctctatgccctatgacagacctcagaccatgacattcagtccagaaaaatcctggaggcgtcttgactgttgagaaccaggagtagagtcagctcaggaaggggctgcctagagatttccactgggaggggcagctgctgtttatgaaatattttcatatggcattgattactgaaaaaatgaacaggaatggagttgatcagatttgcaattagagacgatcactctggctgctgctgtagagaaggaacttgagcaatgtcagcaaggacacataacactgatcaggaggtcattgcaaagactcaggcaggagatgatggcagcttagacaagggtagtggtggtgcagatggagggaccagatctgggagatacatgggaggtgaaatccacaggcctgggtaatggaccgtatggtgggaattagcaagcagacaggtgaaggtaccattgtctgagaagacaagcataggaggggagcaggcaaaggaccggggtgggagatcctggcttcattcttagatgcgcttagttttgggtgcctttgaaacatcctggtggagattccaggaagccaggtaggtacagggttctggaactcagaggagaggcatgagctatagagaccaccagcctggagatggtaaaggaaggaagagaatctttaattacagaccaggaaacaaaggcatagaacaggaaagagatctaacaaggttcacagtctcagtggcctagcagcacaatatcgtcagtgtggtgggctcagtaacaaccctccaaaggtctccacatcctaatccctggaacatgtcaattgtcattgtggagggctcagtaatgaccctccaaagatgtccacatcctaatccccggaacttgccaagatgttaccttacttgctagaagggggctctgcagatgtgattaaattaagcatcttgagctggggagattatcccggattcaggataatccaggtgggttcaacgtaatcacaaggggttctgttagaggagaagacgatgtggtgagagaagcagagattggcgcaatgaagacaaggaaggcagcccctggaagctggaagagataaggagcacattctccacggagatccaggaggagccactgctgacacctcgatgtgagccccataaaactcatttctgacttctgacctccagagctgtaagagtgtcaatatgtgttcttttagaccactaagtttgtagcaattagttacagcagccacagaaagctaatacagctgaactcacattattattgaccacataaacctggatccttgggggactctttgactgtaagtaacaatactgtgaggacatttcctgctgacttaacaagaggtcttggggctgattcagccactcagactctccctccttttgctcagccttcaggttggtaacgtctctgcccacaatcatagtatggccgccataactccagcatcagcacctcacgggacaatgtctaagcaggatgaagggcacagaagtcaggggcctccagatgctcaagacctctggatttaatgaagagaacaatgattcctgcaaagcccagaacacttccttttacatctcattggccagaattgatcataggctcactctgggactgcagagtgttggttcctcccccttgagggacaggttcctgcctgaggggagagtataacattctactctgagctctcttccaggttcccaggtcctgagagattaacccactccctccaaattgcttctttgtgtcaagattctgacaataggacatgagggacacagactggacaagtcacaaagaaagctcctttctgcaagattgcaacacctgcctcatcagagcctccagacttgtggctagcactctgcccattttggttccttctcctctgagccctcttgttccccaggttttgggagacacttccttaggggagtggcaacagccattccttggcagtgtcaatctcactgagagtttttgaaagttcatcatgtgcaccgaaaaaaaaaagcagaattctattaacaagagagactagatattgggtaagcaactagtagtcgctgccacaaactctttgtatgcttacttggggtagcctaccaggcttaacccagttctcagccaggggcgactgtatgtcataggaacatgtggcagtatttggagacatatttggagtcatatcatgggggatgtttctactggcatctagtgggtagagagaggccagggacgctgtcaagcattctacaatgcacatgacagccccacaatgaagaatgatccgattgcaaatgtcaacagtgctgaggttaagaaactctgacctaatcccttgggagcaggataggggtgccaggtttaccaagaggtgtattcatattttttttggtgcgggggagacggaatctcgctctgtcatccagactggagtgcatggcgcgatcttggctcgctgcaaattccacctcctgggttcaagtgattctcctgcctcagcctcccgagcagctgggattacaggcacccgccaccatgcccggctaattttttgtattttagtagagacggggtttcaccgtgttgcccaggctggtctcaaactcctgagctcaggcaatctgcccacctctgcttcccaaagtgctaggattacaagtgtgagccactgcgcctggcctgtacttgtatttatactaaaatactattccttgtttatttgaaattcacacttaactgggtgtcctgtgtttgatctggcaaccctagaacagggtcagactctataccccagtgtttgctgtcgcccagggcttaacaacctaacacacatttgtcaaatgaatgaaaaaatgaggatctcaccaaagatgtccaaggctgctgcacaatccggtcaccttggtcaaaataccttcctggagcccatgcagatagcctccaaaacacaaagcagccatctgcttcctgggctccatgacggcagcagatcccctgcaaagcagctcggatatcttccctttccctccccttcctccagggaaggttggctgcctgctctgcagtgacactgcagggtcagaactcagcctgtgagtaatccaagaacagtgcctatttgaggggttcctcgctgctgagacagacagcctgtggccatcagtcccaaatagcatctgttaatggcccactggagtatggtccctgtcgaagtcaaagaaaaaagcccttaattcactaatcgtctaaacagacaacaccagctgataactcctatagcccagcttatgattctttatgaatctcagtgaatgcagctgcaaacagactataaaatttgttttatccacaggggaaccctttagagggctgatggtggaaactggattcatgaggacccactgccctggattttcatagtcaagttttgcaggcaatggaagaacatcccagggcctcatatgacagcacgtttctgattccatgaatactcattgtgcaccgccctaaaccagacaccgagtatgcattttaccttcattaatcttaatccacatgacagcttgcagtgtccttgatagtaaccccattcttaagatgaggaaactgaggcccagggaggtcagctaaggaggaaggaggggccagccagtggaggcagagcccaggttagttagaacattggccttggggctgtactgctcttttattaaatcaccaccataatatatcagctcataagtgatttttctggacggggattgcaaaaccaggtgtgctatcttagagagagccctaaactgaattgcatttatggtcaaatagatcctgcttccccctttcaagaacttttgtccaccaaagatccatgagctctaccttttccgcagagatctggagctgtgctgcctggggacaccttattttaatattcacttacatgtgattaatgctgcttaacaaaggcctgtgtgcctcagtttcatcacacagtgaaatctacaagtttaatcttccttgcctgcttatccaaaaaagaactatgggtggatggttaagcagctagacaaactgtcactgctctctgcaaattttcctcctaattggaggcagccctgctgtctttcactggtaagaattctgattaaacctcattgctttccaaggttaaacgcatgccaccccaggagaccacagttacaccgtttagaatccacccccaaactaaccctttattcctgaatgtgcactttgaggccttgggcattagtataaactacactacacaattatttgtaattaagggagaaaatgtgtactgtgctacaaaaattagccgtgctttgttgatgtgaatcatgtctatgccggcgtgccagcccagagaggcggcataaaatacaattaaatttcttctgacttaatagttgtttatgttgctatttttcataatcataatatctcaagacacagaaacagtttctctctaatgtaattgcgttctaccaatgagacagcctgggtttaaatgaaaactcaggcagaattaaccacaagagtgtattgtatggatgatgctagaattttgttataaagccccatgcacaactgtccccactcaggagcttagacctttatcccaatcccatgagggtgactctgcagcctcttctgctctcgtggaagagtttgagccaaatttcgtgagctattaaagccacctgtgccccagtttagtgtccttgtgctccagaccccagtcatttccctacttttaacatttctcctttacacattgatttggttgacacatattaaaagcctgacttttacaaccctcataaaatcccatctgctccaagctccaatccaaactcagccagaacatgctcagacaaactgttcggattatacttcagcctctcaatggaaggacacacaaagcaagagcaattctctctctctttgtcattaaacgtaagtcaggcattcttcacaaaatgctgccaagaaagccatagaaggaatagcatgacttatacacatcaaaagaaagatcccctcaagggggtttgggaagagtcggggtggcatgaagagcttgaaaggcccaattgtccatccaggatgataccagtgagagatgtcatgaggggcgagagacatgggaggggaaaggctgtgccagacactgtggatggaggcagcaggggctggagcatcaggaggctgtgggggccccaaggattctgctgagccccacccaggcccagctgagtcatggctgagagatttcccacgccagggacatctgagaccctgaggcccctaagtctcccaggcagacaccgagctccagaatgcggccaacagtccccacctgcatggaaggacctggaaaacaggctgaggccttgaacccagaggaccaagtagtttgctgggaattatggggaagaaaggtggctgaaggagctttgcagactccctgagctcatgggtgtctgagctggtaagttaagatcagcctaaaacacctgacctacagcacctgcctacaatgaacacacacacacacacacacacacacacacacgcacacacttacagaggcactcacaggcaaacacacatgcatacacacgcacacacagaggcactcacaggcaaacacacatgcatacacacacacgcacagacttacagcgggactcacaggcaaacacacacatgcatacatatacacacacacacacacacacacacacacacacacacacacacacacacagtcacaaacaagatttgtcccctctcccctaaaggagaaggggcaaaatgcagacatcaccacacgggacctttgaacagtgacaatggaaagaaaacccaagtaaacaagtgataccaccagcccagccacagccccctcttctatgctaaattcaatttgccacgtccccttcatggtgtttccttgatggcaggaaagggatagagtagaaaattataggcagggcccagtgtggggaagagaggcctcaaaaactcaaggcccgagggaaggcaatatgcggtgacacagtggtttccaaaactatttttcctctctacatacacacaaccagattcaccagattcagcacacaaaaaaatgtatttcagaaaagcaaagaataattttttatgtaagtatgcaccaaatatcacataggacatggttatactaaaaaattaatttatcaaaaattcagatttaaccaagaatcctgtattttatttggcaacacacacacacacacactctcacacatcttatctaggactcaacataaaaagcagctaaaaagcaggtcctacccctgggcctccctgccccagcccctagaccctgatggcactttcttggactctaagggcccaattagaaaatcactggtgcagttgggcatggtggcttatgcctgtaatcccagtactttaggaggccgaggtgggtggatcacctgaggttaggagttcgagactagcctggccaacatagtgaaagtccatctctagatatacaaaaattagctgggtgtggtggtgcacgcctgtaattccagctattctggaggctgaggcaggagaatcgcttgaacccaggagccggaggttgcagtgagctgagatcacaccactacactccagactgggcaacaagagcaaaactccgtctcaaaaaaaaaaaaaagcaccagcgcggtggaaagggtatgcgttccacgtcaaggtacagttccacctggttcaaaccccacttgccagcctcgtgaccttgagcaagaccctttacgtctttgagcattaatttttccataaacttaggtttatgtttgaatctgggtatttgctcatgtgtgtgttggaacactgccctctcgcccctcttgtcacccgtctctttcccaccaggctccctgtcactggggaagagaagaggaggctgctctaaagcaggttctcagtggagacagagagcagggagacagactttccctagaggacacccccagatttgttcaccttgtagcgaactgtgaaagggatttcttactgcatctccatctcctgttacagagccaccagagtgttctaattaacttaaagtcattaatggctgggcacagtggctcatgcctgtaatctcagaacttgaggggccaaggtgggcagatcacttgagatcagaagttcaagaccagcctggacaacatggtgaaaccctctctctactaaaaataagaaaattagcagggcactgtggcgggcacctgtaatcccagctgccgggaggcagaggttacaatgagcagagatcgtgccactgcactccagcctgggcaacagaatgagactctgtatccaaaaaaaaaaagtcattcattaaatatagaaacggggtggagaggacagactgaagacccctggcctcttgcttgtgcagcatcgaggaggagagaaaactcaaggcagcccacaaggtgtcctcataagcaactttagtgtcctcataagcaactcaaagagtaatggtgctgggctaggctggtggcacataggacatttgttcatgaagacccttcctgccctgggccaagtttaagtacacaccatggcttagaaggtgggtgtgaggttcaggctttggtgatacttgctggcttgtttttttgggggttttttgggttttttaaatatattacttcccctgaagcattaataacatgctaagtttccaaacttatcagctgagtgatgagttgactataaaacgccgggttggagagtgacaatatgcccctgggtgtgcgtgcacgcccgtgtgtccaaatgaacctacgtgtgtctgttgcccagaatatggctcctatgcaatgatcttgaacacctggttaatgtatttataaaggcaatacaatcatacagagaacaccgctggcatttggcgctcattcccctttgattgagggatgatttttctctccactgttctggaattggtgaagtgttgagacctgcatcacagagatggttctagtctcctgatttaggctgtatggggaatattcccagcccatcctgtcccataatagagactaccagttcttagacatcatctccctcagaagcagggaattctctccacccagagactgcttcatctgcagctcttcatgctcgcttatgattttgaaacccacatcttatgactttgagtctgcgttgcccagtggtcctggcctctgacccatagcttcatcttatgaaaatcctagcccccagttttgtacacctgggccctgatggagacttagataatttctatcccaaccccaggatcgttttgcgcagctttcttatgtggattgatggacaggtccatccctgggtaccataaccactacccaagaagtgtctgaccaagtggaagccaagcgtgttaagggaagaaagttgccaacagcccttctcactggctcccattcagggcctcaggagtgacgtgacccaccccaggggctggaggagagaagctttttggctaaaagtttgagaaaactgtttacacagaagtcccgaagagattcatgctctggtgaaaatcagatgatccaaaaaattgtgtgtgacctgctgtagagatggacagtagccaggagacaccacgcttctgaatgcagatcatctggctctttctgaaaaagggaacccttgatgggctgggattcttagtgacttggagtgctgactatttgaatgtgaatcaggatttgttcagctgcaaggagtagagtaaattaacagttgcttagtcagtgcttctgaaactttcgtgtgcatacaaatcacctgggttccttgttaaacagcagcttctaattcattgggcatggaatggcatctataataagctcttaagtaaagtccacgcttctagtccagggaccataatttgagtagcagaggggtgtacactgcaactaccagggagcttccaacttaattggaatcctccagaattccaatttaattggtatggggtgtggtctgggaattggcaaattttaaatccccccaggtgcttctagtgcacagctaagacaagaaccactgacttaagcaatagagacttttccttaccgcacggtacaagaagtccagaaggccgcgttttccaggctggtttggcagcactatcgtgtccggaattggtgggttcttggtctcactgacttcaagaatgaagccgcggaccctctcggggagtgttacagcttttaaggcggtgcgtctggagttgttcgttctctcccggtgggttcgtggtctcgctggcttcagaagtgaagctgcagaccttcgtcgtgagtgttacagcccataaaagcagtgtggacccaaaaagtaagcagcagcaagttattgcaaagagcaaaagaacaaacctcccacagaacggcaaggggacccaaatgaattgccactgctaggtctggcagcctgcttttattctcttatctggccccgcccacatgctgctgattggtccattttacagagagccgattggtctgttttacagagagctgattggtccattttgacagggtgctgattggtgccatttacaatccctgagctagacgtaaaagttctccacctcccccctagattagctagatacagagtgtccacacagaggttctccaagtccccagcagagtagctagaaacagagcgtcaattggtgcattcacaaaccctgagctagacacagggtgctgattggtgtgtttacaaaccttgagctagatacagagtgctgattggtgtatttacaatcccttagctagacataaaggttctccaagtccccaccaaactcaggagcccagttggcttcacccagtggatcccatactggggccgcaggtggagctgcctgccagtcccgtgctatgcacctgcactcctcagcccttgggtggttgatggcactgggtgccgtggagcagggggcagcactcgtctgggaggctggggccgcgcaggaacccaccgcggagggtaggctcaggtatggcgggctgtgggtcccgagccctgccccgcagggaggcagctaaggcccggcaagaagtcgagcacagcagctgctggcccaggtggtaagcccctcactgcctggggcttgcaggccggccagccgctccgagtgcgggccccctgagcccacgcccacccggaactcacgctggccggcaagcgccgtgtgcagccccggttcccgcctgcgcctctccctccacacctccctgcaagctgagggagccggctccggccttggccagcccagaaaggggctcccacggtgcagaggtgggctgaagggctcctcaagcgcggccagagtgggcgccaaggcccaggaggcaccgagagcaagcaagggctgcagggctgccaacatgctgtcacctctcactatggtggaattaggagccagaatctttccatccttgtgttccaccatccttatcatgtcttcaaccttaatgcctcacggtctcaagatggctgcagagttccagacatcatatccacccacagggtaggaagaaatggcaggacactttgctgtctctctcttcagcaggaactttcatggaactcagcccctccacccacacaacagacatcactttgtctttttgccaggtgtgggttatatatgtggttgccatattcagcaaataaacgtactaaatttaaattgggacaagtttatgctaaacaattattcattgtttttctggaaggtgaatgtaactaggcatcctgtgcttcctctggccctagtaatatttaatacatccacccatataccaataattgacaaagggaactaggatgattacacttggtttagcctccagcccaccctctaattaacccgtccctttatccttagctgagcctgagttcctctctcttattggccagacctgggtcacatgtttgtctctgagccaatcgctggctagagaaatgggatgtgctgactggcttagcctgggtcacatgctccatcctacagccaaacatgtaaggtggataagggagaaggcgttacctcccttatcgaggcgaaaggctgtaactaggaggagggtgcactaaccacgtgttttattttctgtattccgacactttggtatctgggaccatgctgaccctgacctgcctttctgagggttagccaattcttgataaagcatgcttttcaaatacaaaccaaccaacccagagccaatgctccaaccccctcctttattggaccctcctattccattccctagtcacgccagggccaggtgccagacagctaggggcagtccctatgccccagggccccctgaaattattgaaactaactagccaatcccaaaacctgcttacctcgccttcctcatttcgtccctccaaagccacaatcaaggctctttcccacattcactccctctccttcttcctctgccaaccccagcgcttccctgggtggtccccatggtatggtgtgtcccctcctgtcgggacctgtaacaaaccctcttttgagtggcagtcctttcctgacttattatacctcgaattttccatcaatccagtgtactttaaaacagagggaaagcattttttcaaataaatgtattcaagcatctactagtacgccagacattgcttcagtgatgggatacagccatgaacgaagcccatacaatgctcctgaaacagacattctagtgaagtaagataaataagcacatgcaaaatatgtgtcatgtcagatagtggtgggtgttggcaaggaggacagagaacgggcaggaatcgtaagaggctgcaatttcaaatggagcaggcaaggagggccttactgagaaggtgacatttgaagagagagctgaggtagctgagggaggaagccacaaagacatctggtgaaagagccatccaggcacagagcacagcaagtgcaaaggccctgaggtcaggagggattttaactggcttcccctggatgttgggtggagaaacgtgattggcacagacagtcatcagcccttatccacggggggctgaagcaggtgggataaagccagaaagaggggcgctgtggactctgtgctcgttgccctggcactcgtgctggtgccttgagagcactcccaggcagtaatgatccctctgtgggtttctccggggtcagctggggtttctgctctgtggacagcagctggagggaaacaggagtgaatcagtccatcaaatggagtcatggatggaccagtgtctgaagataacgctgtcttcttctgtgctggggctacggttctccccagatgctgaagaaatcattgaaaggacatgaaacaaatagatatattataaagcaagaatagtaaaatgttaatggtggagtctaggtggtgagtataaggtgttcactgtaaaattttttgtttaaaaacgtttaaaataaaatattggggtaagtgacacacagtccttttgtttttttaattccttttaagtaaaaggttgacagtgggcgagctgagagtgtctctgatatcctagttgacctgaccctgtttacggcatggaaacccttcagtcctcatttgcacatttcatggtcacaccaatgggctccttctttttgtcctgtgtcttctcacagaccttggcaaaacaaacacaacagtagtgatgccaaccatttggatatgccaaagggaagccataaagggcttcctttaagccttaagagatgaaagtttttaaattaagaaataaaaattgtatgctgaggttgctaagatcttcagtaagaataaatcttctatccttgaaattgagaaggaaaaagaaactcatgctagttttgctgctgcacctcaaactgcaaaagatatggccacagtgcacaagtgcttagttaagatggaaaaaaccattaaatttgtggatgggagacatgaacagaaacgtgttcagtcaggttctgtattagctgtggtttcagggtccactgggagtcctggaatgtatcccctggtggataagggctgatgattgtctgtgccaatcacatttctccacccaacactctggggaagccagttaaaatcccacctgaccccagggcctttgcacttgctgtaccagctgctgcccacagagcagaaacccagctgaccccagagaaacctgcagagggatcattaccgcctgggagcactctcaagggaccagcacgagcgccaggccaccgaggacagagtccacagcacccctcttcctggaaagcccacctgcttcagggccccagacacaggctgcagctcccagacccccttaacttcacatcagagaccccagagccagaaaggcctttgaaggaaaggccttcttttagacccatttttgtatttgtttttgacaaatgaggaaacagaggcacaagactcagagaatccagcttcttccactcacatcacaagctgcgtctgcccagagtcgccatgcctagcctcgggttcctggtgcaagacgacacacatagacacagaatgggattcgagttggattcacaaggaaaagggtttcccccaaagcctaaagacgaagaaagggtcagaccaaatcatgtttccacccagtatcttttgagtactccctatgtcgggcactattctacagcctagggctacagtaatgaagacagacacaattccttccctcaggaagtggaggtgatgatgttagcaaatgaatacatgcagtcatttcaaagagaaataaattataagaagagaacaaagggaggcaatgggccagacagcaagggtggtagtggggctactttagatggacaaactggggagactgtccaaggccatggtgaggagcttggattacattcccataaaatgaaaatgggttagggggcttagatggggaagggacatgaccagacatgtattctaacaccatccttctggctgagtgtggagaacagattgtcaagggtgagggtggaagcagagagaccatcctctctgggtggaagcgaagccactgtaattgtcaggcaggagctggtgatgcttggactggagtgcatagtgcagatagtgaaacgccgtcagaccctgtacgtatctgggggactggaggtggggttgaggcaaagagaagaggaaaaacaacacctgcattttaagctgagccactaggttgatgattgagccccagctcttctctcctgggagcgataaacatttgctataagatctgtgattcaaataagcttaatattaagctcagattataactttgtgtcagcgactcttgatgaaaaccaagaaaatatcctggcataagaaagtctgatggggacacaggagagcagcacaaaggaaaccatggaagcctcaacatagacgtattattttttctcgccattataaaggtggagcaactagggcacagaaaggttaagaaacttgctccaggtcacacagccagaaagcagtaaagccaatatttaaacctagtgccatgtttttatttacttatttttaattttttttttaagacaaggtctcacttggtcacccaagcttgagtgcagtagcgtgatcacagctcactgcagcctcaacctcttgagcctcaacctcctgagctcgagcaatcctcccacctcagcttcccaagtagctgggactacaggagagtgccaccacacccagctaatttttttttttattattatactttaagttctagggtacatgtgcacaacatgcaggtttgttacataggtatacatgtaccatgttggtgtgctgcacccattaactggtcatttacattaggtgtttctcttaatgttatccctcccccaaccccacaacaggccctgggtgtgtgatgtcccccgccctgtgtccaagtgttctcattgttcaatttttgtattttttgtagagacgagggtctccctaagttgcccaggctgatcttgaactcctgggctcaagtgatcctcccatcttggcctcccaaagttctgggattacaggtgtgagccaccatgcccagccatagagccacgttttttaatcactgcactattgaaccagtcttcaggtagaggatattgaattgttccaatttgaaagtttatttttaattgtaatacacagtgtgactgggaatgtctttatatattcatctttgcctccttgagcaagtatttctgaagataaactctctagggagtggagacagcggtcttagggtccctcatgttctgtggagtctgtcagcttccacctggcagccctccactctcacatctttgcccgaaagtcctcctttctacgaatgagccagggccccctgcccaactgttgaactggccttggaaggtggccaagctccttccaggaggtgaggggtggggggagaatgcgtcttctgaacctctaaatagacccaggtcaacaaggctcatcccctaaagtccaacacattatctcatggccggcttcagccagcaagcaggcggcctcctgaaaaatttatcatttgctattttctgctcatccatgcaggagttctgacagtcctcagggccagagacttctccactgagataatcccagcattccatccagttccggggcagagaacagccgtccatcctcattagggtccggttaggaggatgaagccggacacgcaagatgaggggctcattctgtttcctattttgggggttgagtgtgcaggtttttactgagaatggcttttcctttccctacgtgaagtggtcactcctccctgagctgcctcttggaagtatcgaaagctcagcggaactggttttgtgagcttactgatcagaaagtgctcgaaagtgtcatcaaagtttcaaatccattaggaaaatctgtttgggtgatgttcaaagacctttaggcttttgtcaccaggaggctaagaaagaagagaaaagtttagaagctgagaccttgtttgtgtggtttcctttggtcaaggaggccatggcagttgtgggtcctgccagggtgttactggcttaattcaattcagacgacctttgatgagcctctttaggtgccagggctcagccaggcactggggcaccctgatgagtgtggtctctgacttggggagcaaattgtctagctcaggtccccgaaaaacagccgtctgcctacagtctcatgattttgcaacatctctgtgacatctgggaagaagagtgattgctgaagcacagggctgcgctgtgagcccattcctgagggtgccaactaactcagccacaggcaagagtgtgtctacaactcccagagcccccaggggaagcaggagtccctcaggagaacaggacaaagaccatatgaggctcccagctcagttccccgcttgactctgcttctggacaattttcaaacctgagacaagacagacatgttccctcttggatccaatttccatatagttaggaatgtggaccaaggaattgcaaagggcacaccttggcctggggtttccaggtgcttttcttctttctacaaccccccaagtgatctttattacataaataataaactgtcatttttaaaactcaaagaacacgaagcaaaagtagttcctcatttcccagttttcacactcatcaccccaggccagtatcctattcaacgtgatgtgtgtcctctaagaatacacaaacacacacacacaaacacacatgggttttggggccaaggcaaagagcaacagggtgctctctagagggtgactccagagagggcctctcggacgaggtgacatctgcagagcctggagtgagaggacaagccaggcagatatctggggaagagcagccttggcagagggacctgcaagtgcaaaggccctgaggcaggagggttctcaagggggttggggagcagcacagaggcccatgtggctgcagcaggggagtgaggtggggagtggcaggggcggaggttgaagagaggatgaggggtcaggccatggagggccttgcaggccatgaggaatattttggcttttattctgcatgagagggtgggtccctagaggactctgagtgatggaatctgatgagctgacctaataggatgaaaggcccaccctggctgctgaatggagaacacaaggcagtggccggaggcggagccaggaacccaactaggagacttggacactagtccaggcaagagatgacaatggtgagatacagacaagtcaagatcctggcttgactgactccagcttcattcttctccctgtctcaccctccctccctctaccttcccaaagagttcccgacctcacgtactctggctatatctatcatttaaaaacatagccatgttagtcatctgtcacaccctgtgctcctgtgtcacccaagtcaggtgtcccaggaacaggtctggagagggtgctgtgggcatctgctactcagacttctcttgggtagaagtctccagactggcaaattaggtctaaaccttcaaagtatctgggaaatgccaagtccccccaaaacagtggtggtttggacctggtcctttacaatgctgagtgaactcatcatttccaaaaatgagtggccgcgagcagtgacgctagagcaggtgagataatattacatgccatgtgataaaggccctcttttatgtgacaaaggccctcttttacattctgtatttatttcaatatatattactaggttggtgcaaaagtaattatggtttttgccactgaaggtaacgacaaaaaccgcaatgactttagcaccaaccttattttaaaaaaaaatagaaaacaaggatatgagatccatgatgactcagccataattccatgggctgaggttgaatttagaaaagcgagtccatttcaagagaaataatccatagtcgtacagggcgtgccctgagatggcctgagcagcactcatgagggggtgtgcaaatggaagacattgagaaacggggagttcctgccaagctgggtggtttgggcccgggtatttaatttcctttggtcaaggcgagcagaggatcttccagcccatcagagtcacagaaagaggtgtcagggtgaccttacccccggcccagagcgggtgggaaggtttagtcatggaaagaaattggatctgtttttctccacatgtccccggggttaatctggagaaaacaagttttggttggctggcccagcttcgcttaaaatatttaaaactggcttcttttgcccttcacagcaatatctcccaggttcttacctcccatctgagctgtctgtctgcattagggctgagttgccgaaggagcatagatcctgtttttgtgtaaaagatgctgatttatagaacctctttattatggctgttttaatgaagcaggttactgtccccaaggggagacttaacttgtaatgccgctaatgcatagatgctgctgtcattgaaaagaattgttaaaattgtactttaatagtgagttgatataaatcttcaatggcttatttggacaggggtgaatgcacccaacaagtagatgtgtaagggagctacagacacgagctcccaccagcgaatcgcctctgaagttagtgccatggaaacacaagcactcaagacagtggttttatccccggtaaaaataagacaccattccggccaggcacagtggctcacatgtgtaatcccagcactttgggaggccgaggcaggcagatcatgaggtcaggagatggagaccagcctggccaacatggtgaaaccctgtccctactaaaaatacaaaaattagctgggcatggtggcaggtgcctgtagtcccagctacttgggaggctgaggcaggagaattgcctgaactcaggagacagaggttacagtgagccgagatcgtgccactgcactctagcctggcaacagagtgagactccatctcaaaaaaaaaaaaaaaaaaaaaaaggcaccattccacagtctgcttgctttttgccaacacagcattcagggctgctgactacagcaggtgaattatgcacaaggtgacagcttcccctgcattctcggagaagagtctggcaggtcgggtaaactgccaggctttgctccttttgcttctaaggcagaatctgcagacccagagaagacaagttctcatcaccaactgcctcatcctggtttgaagacaggttctcatcaccaactgcctcatcctggtttgagaagagcgggcaaaggattgattctgcttggactggtctggattcacgcattcaacaaatatttgcaccttctacgtgccaggcactgtacttcatcaagacaccaaagggcttttggcgtagaaataacatgaactacaataccccgtggctgcaggctgctccctgggagatggaggggtagggtggagatggtgaggtggctctggctagttggtgtgactgctgcctcctccagccagtttctgatttttagctcacttttagtgagctcacatggcacccccagagggtgaagtgtggttctaagccatattttcttccctttttttttttttttttttaagactgagtctcactcactttgtcacctaggctggagtccagggcatgatcttggctccgtgcaaccactgcctcccgggttcaagtgattctcttgcctcagcctccccagtacctgggattacaggcatttgccatcacacctggctaatttttgtatttttagtagagatggggtttcaccatgttggtcaggctggtctcgaacttctaacctcaggtgatccacccacctcagtctcccaaagtgctgggattacaggcatgagccaccatgcccggccctaagccatctgtttaaagcatgttatttaatctttacaactccatgtggtgcatagtattactaaccccatttcattgacaaggaaactgagtcacgtagagttaagaaattcaacccagtgcataaatgaaacagccagaatttgaaccatagtttgttgaacttcacagtctctgttttaatcactctgccatcccctcctccagggagctgccatggctgaagtcagataatcagccctaaaattcaatatttggaacttggcagggtgtttccagtcctagatgacagaaacgaggcaggggctggttgctaagcaacctactggttggcagtggtgactcctgggagtggggaggggtcaatagtggacccaggttatcatgggatcaagatctgaccaatcagagcatcccatttccccagctgtggtgattggctctcagggttgtgcatgtgaaccaagtcactccaaaagcagctggaccaaggacttttcatctctgttgggaaagaggtgcctgccatctgctggggtggctgagctgggatattaatccagagctgctgagggattgtccctgttgctcctaggggaaaatctgccttagagtatagccaccatggagataatatgagagtccagaaaacagtgtcagcatcaggattgagctgagctttatatgagccaataagttccctttcagcaagttgggcctcccaccacttgtagttacaagtaacctctagctactgtagggcaaagactagtgccccatttgacaggtgatacaactaaggctccaagcagaagacaggaaaaggggaggagccaacgttaatcatctagtacttgccattcactgtctatattgctttatttaatgcgactaagctgggttgcaagctttagtgtgacactgactgtgatggttgactttatgtgtcaacttgactggaccaagggatgcccagatgtctaacatgatttctgggggtgtctgtgagggtgcttctcagaaggatgagcatttgaatctgcacactgagaaaaatggatgggcctccgcagtactggtaggcatcctccaatcccttgaggacctgaatagaacaaaaaggcagaggagggctgggtatggtggcttatgcgtgtaatcccagcactttgggaggccaaggtgggaagatcacttgagcccaggagttcaaaaccagcctgggcaacatggtgagatccccctctctacaaaaaaaaaattaaaaataaattagccaggcatgttgtcacgtacctatagttccagctactcaggaggttgaagtgagaggatcacttgagcccaggagttcaaggctgtagtgagctatgatcttgccactgcacttcagccggggtgacagagcaaaaccctagaagaaagaaagaaagagaaatagaggaagggaaggaaggagggagggagggaaggaggaaagaaggaaggaaggaaggaaagaaggaaggaagggagggagggagtgaaggagggagggagggagcagaggggaggaggggagggagggagggaggcccaaggtctgaaagccagtgcttccaagggtaaccctttccccttgacccttgctcttgcccccacagtgtaggaagttgaactttattctgctgacatatctgtgtttgagcttccagacaaacttcatatctgcaactgcgacagttctgtcccaggcaggatcccagcaggaggcagatagcagatctgcagagggaaactgaggagtgtacaatggagggagtgtttacaaggagatagcaggttaaaggaccccaaagagatggtgacggcccccaggactagcatcagagggaagggaagctgttaggaccccaggcctgaagccgccaaggaagaagatgatgcggaagccagcaagcgctgcatgtgcaggagaggatccactgcccggcatgagcacggccttgggaagagaaactcagctctgccagcctctgcactgcaagccttttgtcgaacatatgtttaaataaataaaagaaaaagcagcagtttttaattttgatgcaacccaattcatcttttttgatggctggtgctatttacatcctatctaaggaatgcctgtgttcccttctagaagttttagagtttcagcttctatgtttaagtctgcaatctatttaacgttaatttttgtatggtatgagttagaggttgaagttcatttttaccctttttgagtattcatttacttctaaaccatttgttgaaaagactttcttttccccattgaattaccttgtgcccctggtgaacattggttgaatatatacagacgccttcaccctaccccagccctggggaagccctgctctcatccaggctcctgggtctgggtttgaggcccccttggggctctcaccctggccctgtggtgtgggcatctcagcataatgccccggcttcccaccctgccaccctcccagcatcacccatgcccctctccctgctgtggacctggtccagtggctgccaggtgggttctgtgcactagctcctggtctgggcccttgctccatgggtgactatggacaagggggtgccccttcctgggcctcagtctccccatctttacaatttgagacctgatcaggttaaggcccttccagcacaaatgttccataattctgtgattccacaaagagaatccaagaaagttccatggagcttaaccaggggcagccatctccctctgcctggagctccggatgaggcccaggtctgtagggcaccatgttggggctgagatagtggggacagaacagttggccctgctgagaagaggagggatgtgtgtgcggggtggggggcatatacacatggatgcacatttgtgtgtgcacagctgtatatacattctgtgattgggtggggatgctgatgcttgagtactatacacaggtgtggcgcagcacagcatgatctgtgggggcttgacctgtttgtacacatgtgaatgttcatctccatgtgtggtgcctgggccaggtatccatgcaggtgcatgcatgtgggtgcacacatgtgcatatgtgggagcgtgtggacgtgcactggggctgtgtgcttggggctcacatttatctcatgcctgttgcttgccagccattcttctaagcactttccatgcattaactcacgcaacccccatgatggctttatctgagattgtttctcaggtttgaggaaactgaggctcacaagggttaaaccatgtgacccaaatgacaggttcagaagtggtgaagctgggggttggacccaggctgtctggtctcagaatgagtgatgtggcccatgtctgtggggtctgtgtagacagcggggcgtttgcattcaactgtttcagggggtgtgcacctgtgtgtgagatggcgggaaaggttctgcgtgtgtgcatacatggtggagtgtacgtgtgtgtaggtacaggcatgtgttgtagacaggctttgcacacacatgcaggtttgtgctcacacgtgtgcatctaccagtgtccccatgggtgggtgcttgggcatgtgcacaggcacattggtggggacgtgtgaatttgcaccccagcatgatagaggggaacctcggggccctggcagagaacagagggaagccaagctctctgggaggagagcagcctgctctgtgagttgcattccacgctgcacatttgtgttttccaaaccgggggatggagcactaacgggtgtcagccgcccttggagaatgagggatgtggagagaagggcctcctgggctgctccttattgcacagattgcttttaggggacacatatgaggctggtcttactgagacaaggggtatggccccaagacaggcctcactcatgacctagcgcctcccgggaacttctcagggtgttacaggtggaagattggagacaccctgccctggagctgggcgcgaagccctgggctgaaagttttcctggccagtttgagctccgtgaccctggagaggtgcctcccacctctcagactcggtttcctgctctgggagaagaagccacagcggcatccgtgatttctgtctggatgtgtccgtcctgcccacctttgaccttcccttgtggacttggtccgcctcacgctgagccatggtatggaccaggtggggctgacccagcactggcctggggggatgtgtgaccccagggcgaccatgcagaatgctccatcctcctggactctgattggaagtgggagggacattgtttcctgtggccactgtaacaagtcaccacaaacaaggtggctcacaacaaagacattcacatctcatggccctaaggctggaagcctgaagtcagggtggctgtggctccctctggaggctcagggcatggggggagaattcgttcttggccttttccagcttcagatggctgccggcattccttggctgtggccacatcgctccagtctctgccaccatggccacattgcctcctcctctgtcttctcttccctctcataaggacccgtgacagtatttagggtccactcaaaataatccagaatcatttcctcatcccaggatccttaccttagtcacatctgcaaagacctcttttccaaatacgtgggcaccgcaggttccaggtatttgatgtggacatctttcctgggggctgttctgtgggttttcacagacatgtgaccacaataggccaatgggagcctgccctggggcttctgcaggttttgcgggaaagagacgttctctgtgccccgaggctgctgagctgaggggtggaagccaggagctgccagtggtcgtcatggtcccccatggaaactacctacttgggagtgaagccaacacagaggacagcagagcacagagatggagacggactgcgtcgtggccagattgttggagccctggagccagctgggtcagaagcccaatacgcctgacttcattacatgggctgggaggttttcttgtttcacttatttctgtttgaactgagcttctgtcccttacaaccagaggaatcttatttatttatttatttatttatttatttatttatttatttatttatttattttttgagacggagtctcgctgccgcccaggctggagtgcagtggcgcgatctcagctcactgcaggctccaccccccagggttcacgccattctcctgcctcagcctcccgagtagctgggattacaggcacccgccaccacacctggctaattttttgtatttttagtagagacggtgtttcaccatgttagccaggatggtctcgatctcctgacctcgtgatccgcccgcctcggcctcccaaagtgctgggattacaggcctgagccaccgctcccggccaaccacaggaatcttgaccaacagagctcggggttattcttggggtcacctaaatgatgggaccaggcagacctatggaagaaactgttgcttcacaaaggccgtgtcctgtctatctggggaccagaggctgctgagcagtttctccaggaggggcagggctgtgcagagtcccctctcccaccttcaggatggcctcaggctcaggtcacaatggggagccacggtgccgagctctcagcccctcttcccaaggatcatgcagggtctgaccaatgaactcagctgatcccagtcagatgtgtctgcaattggcagtggctccctggagagggcaggacttgagccagatgaaggaagggagaggtatacagagcacataccatgcttgaaaaaatggaatatgagggtgtggtggtgcagacctgcagtcccagctacatgggaggctgaggtgggaggatcacttgagcctgggaggccaaggcttcagtgagccatgattgcgccactgcactccagcctggacaacagagagagaccctgtctcaaaaaaaaaaaaaaaaaaaagtcgaatatgagtcatttgtccaatgtccatccccctcccctccccgggcctggatgctcctaaaggtagggctggtgcacctgcagttcaccccttctagggtcgtggcctcccagaatccaactcagatcctatccctcctctgctcaagccctgcagtggctcccaactcactcagaacaaaagccaaagtcggggaccaggcacagtggctcacgcctgtaatcccagcactttgggaggctgaggtgggtggatcacctgaggtcaggagttcgagaccagcctggccaacatactaatcccatctctactaataatacaaaatattagccaggcatcatggtgcaggcctgtaatccaagctactcaggaggctgaggcaggagagtcgcttgaacccgggaggcagaggtttcagtgggccaagattatgccattgcactccagcctgggcgacaagagtgaaactccgtctcaaaaaaaaaaaaaaaaagccaaagtcctcgcaatggcacatgaggccttaatccactggtctcaccccactgccctgtcagctttcacctcagggcctttgcacttccttccatcttacaggaattctctaccctaagacatgcacgttactcatttcctcccatttttactcaaatgtcaccttgttagtgaggctgtccccagccaccccatccacactgcacaccccatcctcccctcctgctctctttttctccatggctctgtcagtcactattattatataagtaatacactcattgatttttttgtttatgtccccaaattaggctctcagtgccatgagggcagggaccttggtccactttctcctctgttcataacgagcattttctaaatgggaaatgaatgaacgagctctgtcttctgggcccagtgccctgattgccccttgggaagcctccgtcctttactctcagttcatgtgctgcggatgggtgaaccccacacccagctccacgcaaggacaagatctagccctggcaattggcatatttgaggccactgggtacagctgggcagctgtccccccacacaaggaactgaaacccttcccaccaagccttgtgtcctggcacagagctgtttctcctgagaggaaggggcaccctttttctaactcacaccaaggcacccagggatagccctgaccacgagcaaatcccatcaccttgactgcagtgtttgaatcagggacggacatggggccaggttggcacatgcagggatgttaaatcaggtgaatcctgtgaagtcctcaggggccaccaggaagagaaggtctttcttctagggttgctgtgcttgtaggtagcatccccccaccagcgagggaagaggcgggagcaccactgcgtggctgggagaaactaactggctccctggatccagccctaccccaggctggaaccattcctgggattttttttttttttttttttttttttttttgagacagagtcttgctctatcacccaggctggagtatagtggcacaatcttggctcactgcaacctccgcctcctgggctcaagcaattatcctgcttcagcctcccgagtagctgggattacaggtgcccaccatcacacctggctaaattttgtatttttagtagagacagggtttcaccatattggtcaggctggtcttgaactcctaacctcataatctgcctgcctcagcctcccaaagtgctgggattacaggcatgagccaccaggctggcccgggactttcagtgctatgagcccatccattctgtttttgcctaaactggctggggttgagtttctgtcattaacaaccacaggatccttgtctgacccaggaagtgagataacaacaccctgcaggacagccatgtagctaaattagaccctgcccttgaaaagcaccgtgtcctttttaaacacttgaggcatatgaagggctgctggggatgctggcagcctccgacttcatcacctccttcctctgcccagggctgctccccacaggagtctgttcccctccccagtgcagcctctgccccctcctcaaagaaagtttcagcactcacagctcctctctctcagctgagtgattttctcccttcctattttgtcatcttgaaagatggcaaattggagcacttaattttccccctccaacccaattaatatgaaagtgcacagcgctgatgtgcggaagcgaaaagcaaatcatttatatcaattagcaaaaatgagctttgtgcaaactcgcaatgaagaatgatctcagagacaggaagcccaggagggaagcctgggagggacccccggagcctcctgaaggaagcgaggctttgggcgcagtatcaggattgcattttgtcccctctccctcccacaaggtccctggaatcaagagacttaacaggtaaagccatgcttcactgttctcaaatttcaacaagactccccacagcaagctccaatgcaaagtctttcttgtcaacgtgtgtcctgagtcagcccacgtttctctaccgccactgcctccctgagcggagccccatcatccatcatggcccccctgggtaatgataacagcacctctctctctccaggcttccactctggccgccttcaacccacacccacattcatgcaatgtacactgcagtcagattgagcttttatttttttaaaatcttcattcatgtatgtatgtatgatgtatgtatgtatttttgagacagagtcttgctctgttgcccaggctggaatatagtggtgcaatctcatttcactgcaacctctgcctcctgggttcatgcaattctcctgcctcagcctcccaagtagctgggactacagatgcctgccaccacacctgactaatgtttgttatttttagtagagatggggttttgctatgttggccaggctggtctcaaactcctgacctcaagtgatcctcccacctcagcctcccaaagtgctgggattatagataccagccaccacgcccagccagactgagcttttaaaatacaaatcaaatcatgtcaccctccagtgctgaaaccattgctgttagaataaaatctaaactcctcatcacggcactcagggacccacgtggcctggcttctgccgacctcccagcctctcccctggctccctccattgcagccacgcgggcctccttgctattccttcacgttgccttgctcattcctgccctgggccctttgcacgtgctgtttgccacatcttttcctggctgctcagttttatctttctcgccttgattcaaacgtgactcccccacccaggcgaatgtcactgtccttggttgctatgtatccccttcacatcccttcaatccacagacacctggtaaacacctttcgtgttccagccacattcaaggccctggggatatggcaacaaataagatggacaaaaaccctgtttcatggagttatatcctggtccagatggtgggagaagtgtacaaaaactgccagctgggtaaagaagacaaaaaaagatgccaaataatgaaaagcgctatgaggaaaacgaagacgggaagggaggcaaggctgtacttagaagccgggtggtcagggtgggcttcgcagaagaggtgacacacaggtgaagaccttagcgggaggagggactccgtgcagatgtctgggggaagagtgctccgggcagagggaaaagcaggcgcaaaggccctggggccagcccatgcctgttgtgtttgaggagcgtggaggaggccaccgtggccggggcagagtgagtaggggaggggagatgaggtggaggccaggggctggaggctacggctggactctggcttttgctctgggtgaggtgggagctgagggaaggtctggagcagaagaggtctaaacagaacccctctgtgaggatatcaaccatcagggcccagacaagcactggttcgggagcagtgatgactatggagtaggtttgccgaaggagggccatgtttcttatctttgattctgaatgactctcaaggatcgcacagcggagaaacagaggagaggagaggttttaactcttccctgggggctccaaagggctttcttgggctctctgcttgcattttttcattcattcacttcagacctagcagaggttttggagacagataaagttgggttcaatggccagctccaccacttcctagctgggtgactttgaccaaagaccttaacttctctgggcttaggttgtctcagatgaacaatgggggtcaaacggtaccacttccttcttccttttttcctgcttccttcttctgcttccccttccttcttctacgtccccttccttcctcctttctttcctccttccttccttcttcttcttccttcttcctcattctttccttactctttccttccttccttcttccttccctccttcctccttccttcctccttccttccttcctccttccttccttcctactttcctgccttcctttttttgtcattaaactgttaacttctatgaggactgtgacttggatctacgttgcttattgccctatttccagggcccaagaccttgcttggcacagagtgggtgctccataaatatccatcaaatgggtgaatccccgcgagtcctgagcagatggaaaacaccttgtcagggtcagggttggttggagactggagtaaatgccaaattccagaaacacagatccaagtggggacaacagatgtgtctgccaggaactgaatcacccagcagaaagtgacatgcgtcccaggccttgttctaaattccaagagggcaaacaaacgtgcgttcatgaaatgtttgatgtctgcctgcagctcatgtgtaagctgtaggtcaaatttatgggccagagagagtcgtattgcaaagtgctgtgtgtacacgtgttatcgcactggggccacttgtgtaatcaatatgcgctattcagtctcagggcgtatgttcattgtcttaactatgatggaggtgtagctcggagactctgtgccaggagatcagcagagcctggggcctcaaggggactccctgcgggggagagggacagccgtgtagcagagtgacaatgaaggcttctgatttaatgtgcagtttccaggccatgtgtcagccgttcacgtgtgtggtttcattgaatcctcagacagcgcttgagggacggtcctggactaattccattttacagatgacagcactgcagaacagaggggtctagtgtttttcccaaggtcacacagttctcaagttgcagagtaaagacttaaatccagctgggtgcagtggctcacgcccgtaatcccagcactttgggaggccaaggcgggtggatcaactgaggttgggagttcgacactagcctgatcaacatggaaaaaccccgtctctactaaaaatacaaaattagctaggcatgtggtggcacatgcctgtaattccagctactcgggaggctgaggcaggagaatcacatgaacctggaggtggaggttgcagtgaactgagatcgcgccattgcactccagcctgggcaacaaaagcgaaactctgtatcaaaaaaaaaaaaaagacttaaacccaggtccaccctgactgatcaaaagctagggtgcccaaccccccctggtttgtctaggaccgtctctgtttgaaaacgtacagtcccacaacctggaaacctgcgaagatcccaggctaagaggaactgttgttgaccctatgtaagatccatgctttgaaccacacagttaccctttggtgggaaagcatagaaggcagtggtgaggttttcccaggcggtgtaaactcacacagagggacaagaacctgggaaaggaaagggtatgcttgaggagtggggctgtaactgagtatcccagcctcaaaatgcatttggaaacttttttcctttcttgttttcagccttgaaacattctttgaaatgctctggtatccctttcccaccaggcgctcccgggcacagggctcgcttatctaactgtgtgcttgctaagaaattccagaggctcattttgaaacaaactgggcagagagaccaagctgtagaatcatcccgcttaggcggagttatgaaccgttagcccaccactaccaggcaggagccaggacgacacaaatcagacctcgagatgggcgattgttcgagatgaccatcagaacaaaacccacagccccgcaccctcctgctccactcatgctccacccctgctccactcctgctccacccctgcaggcttcctgcactaagttttccttttttttttttttttttttttggagacagagtctcgctctgttgcccaggctggagtgcaatggcgcaatctcagctcactgcaacatctgcctcccaggttcaagcaattctcctgcttcagcctcctgagtagctgagattacaggcacatgccactatgcccagctaatttttgtatttttagtagagaagggggttcaccgtgttggccaggctggtctcaaactcctgacctcaggtgatccacccacctcggcctcccaaagtgttgggattacagatatgagccaccgtgacgggcccaagttttccttcttaaactcctcattcagcccaaaaggcagagatgacttctttgaagcagaagcctggccgtcttccagctgcttgtactggatcaataaaagtgccttccttccaccacacctcgctaccgcttctcgcattttctgcctctgaacagggagcagctggacttcagccaattagagaagtggccatatttcattggaattttttaactttccattttaaagcaagtatagactcataggaaactacaaaacatattacagaggggtggagccaagatggccgaataggaacagctccagtctatagctcccagcgtgagcgacacagaagatgggtgatttctgcatttccatctgaggtaccgggttcatctcactagggagtgccagacagtgggtgcaggacagtgggtgcagcgcaccgtgcgcgagccgaagcagggcaaagcattgcctcatttgggaagcgcaaggggtcagggagttccctttcctagtcaaagaaaggggtgacagacggcacctggaaaatcaggtcactcccaccctaatactgcgcttttccaatgggcttaaaaaacggaacaccaggagattatatcctgcacatggcttggagggtcctacgcccccagagtcttgctgattgctagcatagcagtctgagatcaaactgcaaggcggcagcaaggctcagggagaggtgcctgccattgcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcatgcagctggagatctgagaatgggcagactgcctcctcaagtgggtccctgacccctgacccccgagcagcctaactgggaggcacccaccagtaggggcagactgacacctcacagggccgggtactcctctgagacaaaacttccagaggaacgatcaggcagcagcatttgcggttcaccaagatccgctgtcctacagccaccgctgttctgcagccactgctgctgatacccaggcaaacagggtctggagtggacctctagcaagctccaacagacctgcagctgagggtcctgtctgttagaaggaaaactaacaaacagaaaggacatccacaccaaaaacccttctgtacatcaccatcatcaaagaccaaaagtagataaaaccacaaagatggggaaaaaacagagcagaaaaactggaaactctaaaaagcagagcgcctctcctcctccaaaggaacgcagctcctcaccagcaacagaacaaagctggacagagaatgactttgacaagttgagagaagaagacttcagatgatcaaactactctgagctacaggaggaaattcaaaccaatggcaaagaagttaaaaactgtgaaaaaaaaattagacgaatggataactagaataaccaaagcagagaagtccttaaaggagctgacagagctgaaagccaaggctcaagaactatgtgaagaatgcaaaagcctcaggagccgatgcgatcaactggaagaaagggtatcagtgatggaagacgaaatgaatgaaatgaagcgagaagggaagtttagagaaaaaagaataaaaagaaatgaacaaagcctccaagaaatatgggactatgtgaaaagaccaaatctacgtctgattggtgtacctgaaagtgatggggagaatggaaccaagttggaaaacactcgcaggatattatccaggagaacttccccaatctagcaaggcaggccaacattcagattcaggaaatacagagaacgccacaaagatactcctagagaagagcaaacacctctacgcaaataaactggaaaatctagaagaaatggataaattcctcgacacatacaccctcccaagactaaaccaggaagaagttgaatctctgaatagaccaataacaggctctgaaattgtggcagtaatcaatagcttaccaaccaaaaaaagtcgaggaccagatggattcacagccgaattctaccagaggtacaaggaggagctggtaccattccttctgaaactattccaatcaatagaaaaagagggaatcctccataactcattttatgaggccagcatcatcctgataccaaagcctggcagagacacaaccaaaaaagaattttagaccaatatccttgataaacattgatgcaaaaatcctcaataaaatactggcaaaccgaattcagcagcacatgaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcaacagcccttcatgctaaaaactttcaataaattaggtattgatgggacgtatctaaaaataataagaactatttattacaaacccacagccaatatcatactgaatgggcaaaaactggaagcattccctttgaaaactggcacaagacagtgatgccctctctcaccactcctattcaacatagtgttggaagttctggccagggcaatcaggcaggagaaagaaataaagagtattcaattaggaaaagaggaagtcaaattgtccttgtttgcaaatgacatgattgtatatctagaaaaccccatcgtctcagtccaaaatctccttaagctgataagcaacttcagcaaagtctcagaatacaaaatcaatgtacaaaaatcacaagcattcttatacaccaataacagacaaacagagagccaaatcatgagtgaactcccattcacaattgcttcaaagagaagaaaatacctaggaatccaacttacaagggatgtgaaggacctcttcaaggagaactacaaaccactgctcaatgaaataaaagaggatacaaacaaatggaagaacattccatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagccggaggcatcatgctacctgacttcaaactatactacaaggctacagtaaccaaaacagcatggtactgataccaaaacagagatatagatcaatggaacagaacagagccctcagaaataatgccacatatctacaaccatctgatctttgacaaacgtgacaaaaacaagaaatggggaaaggattccctatttaataaatggtgctgggaaaactggctagccatatgtagaaagctgaaactggatcccttccttacaccttatacaaaaattaattcaagatggattaaagacttacaagttagacctaaaaccataaaaaccctaaaagaaaacctaggcaataccattcaggacataggcatgggcaaggacttcatgtctaaaacaccaaaagcaatggcaacaaaagccaaagttgacaaatgggatctaattaaactaaagagcttcttcacagcaaaagaaactaccatcagagtgaacaggcaacctacaaaatgggagaaaattttcgcaacctactcatctgacaaagggctaatatccagagtctacaatgaactcaaatttacaagaaaaaaacaaacaaccccatcaaaaagtgggggaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggattataaattatgctgctataaagacacatgcacacgtatgtttattgcggcactattcacaatagcaagacttggaaccaacccaaatgtccaacaacaatagactggattaagaaaatgtggcacatatacaccatagaatactatgcagccataaaaaatgatgagttcacgtcctttgtagggacgtggatgaaactggaaaccatcattctcagcaaactatcacaaggacaaaaaaacaaacaccgcatgttctcattcataggtgggaattgaacaatgagaacatatggacacaggaagcggaacatcacactccagggactgttgtggggtggggggaggggggagggatagcattaggagatatacctaatgctaaatgacgagttaatgggtgcagcacaccaacatggcacatgtatacatatgtaacaaacgtgcacactgtacgcatctaccctaaaacttaaagtataataataataaaattaaaaaacaaaaaacaaaacaaaacaaaacaaaaaaaagaataattacacatagtgtccgaattttagaggaaccaggcacagaggaaaaaaacatgttccaagttttgttaagaggagtatactgatcgacagtgttaaaagctgtagctagtttaaaataaagtgtacctgactttaaaaaacaaaacaagaattataaatattctaaaataaagataaatagattgcttccttcttttgttagtttagtctattttaacatttgtcctgcttgatatttataaacattttagctattcctaagttctgttcattttttctgttataaaaaattttttctgttataaaaaatgtaagagttgagaacacctggtaaagctctacagctagttatatgctgtttttcttgaggaagtttaaacctctgtaaatcacaaaatatctagggtggttagaaacataatagacaaagacatttggttatttctgtggtttacaggagcttaacataataattttaattaaaattgacagcacatattcagagattaagaacattaaaaaccccatgtggttttgagacctgtgttaatattactcaggaaaatatattctgaaaaaataaaatattaccatcaaaataaaaaaaaaaacatattacaaagaatcccatgtagaatcccctttgcccagcttcccccaacagcagttccctaacctttttggtaccaggcactggtttggtagaagacaatttttccacagaccagggggcaggggtagggatggtttggggatgaactgttcaacctcagatcaacaggcattacttagattctaataaagagcatgaaacctggagctctcacatgtggagttcacaatagggttcccgctcctataagaatctaatgccgctgctgatctgatggccactcacctcctgctgggcggcccagttcccagcagaccacggatcagtactggcccgtggcccaggggctggggacccctgctctgactgactaggcctgggtcatgtgtcctcccatggaaccagaattaggatcagcctgaaagtgggggacaaaagattctccaagtgaaactgggctaccgtcaccagaagacagaggagagacagatgcttaatgggcaccaaccccagatccggaaggactctgccagtgtgttcaggacaggctgcaggtgagaggtcagctattgtcactggccagtcaagaaatgaacaaggtgggggcaattgtccgttaggcccagagggagcagtgcttagggctcatggcacttgtaggagcccacacaaatattttcatttctttgaaaatcagggccaggtgcggtggctcatgccaataatcccagcagtttgagaggccaaggcgagcggatcaggagtttgagaccagcctgaccaacatggtgaagccccatctctactaaaaatacaaaaattagccgggcatggtggcgggtgcctgtagtcccagctatttgggaggctgagacaagagaatcacttgaatcctggaggcggaggttgtagtgagccgaggtggcaccactgcactccagcctgggtgacagagcgagcttccacctaaaaaaaggaaaagaaaatcagaagaaaaagtgactatactttagcctggattatatttgcttttatgccaacatagtcataaaatataagtttaatttatttctttttaggaagaaggggcccaggaagatggacacagtagccctaggtatttgcttggatatggtggacagagagaggcaattaggaagtttcccaaatttggatcctggcacctaaaaggatggtttggtcatctgaagggggatgggtgaagaactgagtctcagccaacttagttgcaggtgctaaggcgaggataggattatagcctttggggtttggatcctagatctgtgagcaccagagtgaccttgggcaaggccctttacctccctgaacctcttgttccccatccatacaatggacagaataactggcatcttttctggattgtcatggggattacacgaagcatcacatgtgcttagcaaagggttcagcatatagacggtgtctaacaaatggagtctgggtattagatttgggagacctcagaagagaatttgataaagagattaggaccagaaatgagatgacctgaagctgtgagcaaagagggattgtgcaagaaagcagttgaggagagacaaggaggcagaggtcccaggacatgagccactgaggaccctaggagggagacagttagcacaggtggtaagaaaggaggtgtatcctggcctcaggatcttgaaagcaaagggaatgatgggcatcaggaagctggaggttattaccagggtctgagtggtggagaaaggttctgggggaaagaaagataaaatcgatatctgtgcttttgtctgagcagtttctaagccccatccttttcattcattcacttgttcattcatctatgcattctttcagccagcaaatatttactgggcctggagtggtggttcatgcctgtaatcccaacactttgggaggccaaggtgggtgtatcacttgagtccagcagttcaagaccagcctggccaacatggtgaagccccatctctactaaaaatacaaaaattagccgggcgtggtggcgggtgcctgtagtcctagctacttgggaggctgagacagcagaatcacttgaatcctgttgaacatggcgaaatcttgtctctacaaaaattagctgggcatggtggtatgtgcctgtagtcacagctatttgggaggccaaggtgggaggattacttgagccttcgacgtggaggttgccgtgagctgagatagcaccactgcactccagcctgggcgacagagtgagacccagtctccaaaacagacaaaaaaaaacccacaaaacaaatagttactgggatcatttcattgtatgttggtcacaaggtcaccacttatgcagtctctgccacagggccatctggagctctcctggttcccacctgtcccaagtctgcttctcaggcttagctgatcatctgagcctcctttctgcatccagtaaaccccatcggcctcagtgagccagatccagtttctgttgctggaaaccaaagaacccgactggatagctcccccccacacacagtgcatgtgttttgtaggggaatgactcctacagtctacttcagggtgggcatgtcgcctaagccaggccaatcagagcagccaacagtcagtgggcctcactctagtttactgagagtcactgggatattgctggaactctcacaagggagaaagtgtctttccactgggctttgctgagctggtaggatagcagaccagagttgatgggggccatcaccatcactgtgagggaagagctttccaggggatgaagtcaacagcaaaaatcacagatgagaaagggagacaaatgcttcatagtatcactagagctcctagatccagcctctcctgaaacccctagactttcccactgctgggccaatgatgtcccattttgacttaagtcagtggaattgggcttacatcctttgcaatcaaaacacgcttctgtttaacacagagactacaacaccctgaaacaaattgcaatctccgcatttcttcatggacaaatggtgtaactaactaaatgtgagaacgcagcgcacagcagtgcctccgtacctgtcactcacctttcagtcccctaggaggactcaggcatgagcttgccagccagaaaaaaggaaggaagctgcaggctatttctcaaattcacattccaaggtgaacaacaggagcctcacctccccctgctcgctaaactcacacacattcccacatcagcttttcatcacagtatcgggccacccaaagtattccaaaatagaccatctaaattctaagaagacaagcaaagccagtgttaatgaaatgtataatgcctgttgtagctcacaggttagttttacatcaagtttatgggcctggagcagtacatttataatgtatgatgtgtgcatgtttactacattggcgcacccacatataatcaacgtggactagagatttatggccatctttataagacttggagtataatttcattacttttaaatatttacagaggctgaaagttgtaactttccttttatggcgtagtgtgggatactgtggtcctgtctgtgatgtgtttaatactcagtcctcatttagaaaaaccccgaggacagccctgggccttttggggacaagcagctctctgaggaccccacaggaggccctggggaggaggaggagttctgagcagacatgaaccccagtgggtgggcgggcaggtctgtctcagggctcagaggagacccttccctgtgacccagaagctcagaggagactcctgggaagaggcaggactgggctgagcctggaagggcaagtggggccttaggaagggagcagctggggggcggggcttcccaagagaaaccacatgatgctgtggtcgacgtccccaagctctaagtcactcaggtttcatgctgttgtgtctccataaatcttccccagacagagtagagaaagaaggacaaagcataaatccacagaagttggacgatccttattttgggagggagagtctaggtcaatgtctggttctggatgcatggttgtaagcaggaactgtagggaggcactggtgacatgggtgggatcaatacgcagctctctccaaaggatctgagtgaacccattgaaaaagacccctcccacatcccagtggtttccacagtgacgaaaggagactaaaggttgtgtgtgtgtaaattagcagcagagtcagctgcaagtgacaataaacccattataaatgtgccttagggaagacataaaatgatttgcctctgtggtaagcaaagcccagaagtaagtagccagggctgatggaatagcttcacttggaaaaaggattcaggcacaaaccagttattcagtcaagcacaacgcattacacacctcataattcaatatggctgcttgagctccagccatcacactcacattccacttagcagtggggagggaggtgcagaaacatgtgttcctgttccctgaagacactttctggaaattacacatggcccttctgttcctgttccattgacaacaccttaattacacattcacatatataatcgcaagggaggctgagaaatgtagtcattattttgggtagctatgtgccagctgaattctttcttcctgaaagaggaaagggagaacaaaattggaggaagtcagcagtctcttccattctgtacatgaatgtttgcacaggtgaggcccctaggtgtattgtgggaatgtgtccacacctgtgttggaagcattgttcaccatcagttattaagcatccactcaagaaattctgctgtgtaagaaaatgcatggataataaatgcatatgggccatggattctatggaaataaatatatgtatacgaatagatatgggtataagtgtaattgtgtatgctcatgctcacatatgtattccctaatttgcttatttattcagctagtatttcctgagcccctactatgtgtctgggactgtttcacacacttgtgatttagcatggtaacatggcagtcaaggtcattgatctcatgaaatttagtctattggaagagatggacaaaacccaagtacatgaataatcaagtaagataatatcatcatgacatttgtgtaatgaagaaaataaacagtgtggtgctttagggatcaatggggagaacagggtgcacccatgacggacaggagggttgtggagggtgtccctgaggaggtgacattgaagaaaacccatcggcccaggtaccgccaggcatttgtttccagctcactccccttctcagagctccaggcgctgagctccagatgccaccaaagtttattctgccccaggtccacgtggcccaagggaagctcctgtttctcttgcacaacctgcccctccctccctcaggctgcctcatgcagcccgtggatgcactatgtactgaatgctggaggggctgggtaaggagcagtccaggcagagaaagcagcagtgcaaagtccctggggcaggaaagacaatcctctagtggaggatagaaaggaggccagggcacagccagccccaggtgaccctgaaatgaaggagccaggtgagccccaacaccaccctgctgacctcccactgggactccccactggggggacacatcaagaatcagaagcaagggagccttgtggtgtgggccacctggtcagcctgcaggtcacagagaaggggaaggtggggagaggacccggaggacaaagggcagtcatgtggcacaggctggggccaaggccggggcgctggcattcattctgagtcaggtgggaagccgtgggggcagcaggcagagagatgacaaggcctgacttgcaggtttaaagtgtcctgtctttgccatggagacagtaaactgcagaggccccgggtggaggcatctgcggtgacccagggagaagtgatgggggctctgcctaagtgtggacagggcaggtgtgcagaggcggcctgccttgggtcagagtggaaaagccacactgagggactccaggtggctctcaggtctgccttgaacagtagagtgacagccccgtccctggacagaagcagcctgaacgtctgagcaaatggcgggatccagaccctgctggatgctgggggtgagagctggaatgggacaaacagcctctcgccctgggccacctccagaaaagtccacctcgggcctcagaaggtgcagacagcgggaatgagcgaggtgcccaagggtggccccgcgccagggcaccgctgtcctcacattttctttcccatccattaggaggaaatgcactggggccacagccggcttcctgctgagaaatcaatggctcattagagttcacctttgcttcccctctgccctcaggctattaaaactggccaggacagagcaagactcagcctacccaggaaggacagcaggccccgcccctcctgcaaggccactccagccagggcagcagctctgtccccaagaccccccggcagccttgctgagggcctggccccggccctggccctggccctgcagaaaggagaccacgtcagcctggagtggagcaggcgcagctgtcctgcatccccagttcaaatcctgtctccaccactcatgggacctgtgaccctgggagtcacttcccctccctggggcacagcctccctgtctgtaaaatgaggtttaccatgagagtatcagcgctcctcttgcaaccagaggctccactggtttgagcagagaaagcaatagattaaagggttgtcaggggctttggaaactctgcgaggacagagagacaagtgtggggggctatgcaggcagcaggacataggatccctggcaggactgatccctggggatccagcattgctgctgtggccacagataccgcagcctgcaccctgacacccacccaggggccacggtgcaaattcctcccccacactcagtccaggtggttcaagccccttctccgcacagagatgtcacgtgacctgggtctggccagtaagatccgtagactgtctgggccaatgaacgtcaccccaaggttgtgccagactcactgggaaagagcccagtttctgctgagggtgctaagttggaggatggaagcctggctgctggggacctgccttgccactacctgaagggccagtctgagaactccactgacacagagggaagcagggctgagagatggagagaaggcaccctagtgacactgtaagagcccctggatgcagctgtgcctgaagccacattgtgaatgtggaacagcaaaccagacatttttgtgtctttgttcttggttttgttgcagtccttgatttgggttctgccacttgcagccgaaagatcaaaaaataatacaagaaaacacctggcatgccataggtcagtgttaattccaacactgggggaggagggtgttagaggtgagcagtggaggtgaggaaaggagagagatgagagccccatgcacttcttacccatatcctcaaggtgatgggattccaccatctgtgacatgaagacctggggcaggggtccgggcactgcagggaggggccctccattctcatcagctcctctcccctcccagaggtgagcagacatcctcccaggggacccagggtcctgatgtggagtgtgtccaagggagtttatcggagggcagggaagggaccccagacatctgcttccaactgttgccctgttctctgtgccaacagcccacccagggcagcagcgttgtggaatcttcttcccactcacacctggagaaaacgcctcatggagatatgggcagagcctggtatttggcaccaaacacacctgagtgcctgataccctctgtcactcactggctgtgtgaccccaggccggtcacctcgccctcccagcctcagtttcctggtcggtggaatgggggtaatggtaacatagattaagggaggcttaagggagtcgacatgtatgaaagtgcctggtacatggcaggtgcttggaatgtgcgccctggtttttccctcctgccaagaggcctggtgggtgcaggaatgacaactgagtccacatctgcccttggtcaattaaacaaagtggctcggagcgtgaaatgcaactcctggtctgttttcaggactcaataaccattcgtgtggccattatcaccatcgtcaccattgtgattgttatgggttgtggagacgcacacctgacatgctgacttggggagatctgggcactgatcagaagcgtgtttatgtgaggtgctcatagcctgtgatggtcagggagagccttccagaagaggacctgaagtggcatccaaagttcatgggggcttgggtgaggtagggagtgctgaggaacaatagctctaacacacgtgcagctgctgcttatcgatgcgttcactgtgggcagctggggcctgggtgctccaggtgcctgagctcattcaatctccacagccccaggaagtcggtgtgagtttgatcacccacatttgaggctgaggcaggagaactgcttgaacccaagaggtgcaggttgcagtcggctgagatcgtgccactgcactccagcctgggcagcagagcaagactctgtcccaaaaataaaaaaacggttactgatgaggcaagtgaatggcagacaggttagtaacttacccaaggtcacacagcaatgaagtggcaaagtggggatctgatctcagacagctgcgcccaggagtccaccctcttgaaccctacgctgtgctgtcactacggtggctcttcctcgtatcctctccccgtgattttaagacgcactgaatttttaaggacagcattaacttgacattgagggaagattttccgccttgtggcccatccactgccatgctcttgcagtgtgaggtcaccgcaccccaccatcacacgtgtgccagtctgcatttgtcacccacctgcattccctgtcctgctgtgaggtgtgaccacctgatggccccattccagtgtgttcatcctcagagatgtcaagaaagcagctgggtgcaaacgagtcctatttagagaccagatgaggcccatctcagcccaccgctcaaatggggaaaatgtaccttcgttattttctaaaacttcacttagtcttggcagcattagagcaagctggttgaagcatagactctggatctagaatgcctggtttgcatccacttcctcccagcagtgtgaccctggccaagtttactggaacacactgtttctccactgagcatgctgtgcctcagtttcttcatccatgttgtggggataacagaatctttccttagtatggctgagaagattaaaaactctttcccataagagtacttagatcaatgcctgtaatgatagatcttattatttctatttgagtcaatattctgcacgggcagtggaaacgtaatcttagacaatttgggattgatgctttcccttttctgagtctttacctggtaccaggtgacagcagggaccaacatggtgcccaggcaccacctcccagagccagtacttgctgggacatccattcttcagcctggatcatgagtgtcagctcaagtggttgccacggaagtgctccttgtggctgaatgatggtccttcctgccaatctctactacttcagtgttgcttgaggcacatgtaaaacacctcatagatcctgcaccaggggagggaggtgaagggcaggcactccgccaccctcaggacccgactgccaatccaggagttacaaacgcagatttctaaaggggtgggcaaatgacctaagtgggtagatgggctagcggggctgcagaagagccctatgtataagggtggccacttctcagctctgccaagcagttgtataagggaaggcagaccctgtagagcttttctgtttttaaagaagccagagtcgtttgtgtgaaataacctattaaaaaaaaaaattggcaaaaaaatgttcaaagaaccatgtgaaggcaaacatattggaaaggaagaaatgaaactatccctatttgcattcgacacacttgtctatatagataattccagcaaatctcaaaaacaaaaatgaaacgaactcctcctagaaccactagaactaatagtgagattagcaaggtcgacaaagaaaaatcaatcatatttctgtacgataatcacgtatgattagaaaaaaaattaataccacttgaaaaagattcccaaaaatgaaatacttaagtataaatctaacaaacatgtacaggatttgtatgctttaaactacaaaatattgatgaaagaaatcaaggaagacctaaataaatggaaatacataccatgtccatggattgtagcagtaaagatggaggacaaaagcagtcaagatgtcagttctccccaagctgatcttcagatttagtgcaatgttaataaaaatgccagcaggaatttttatacgtacaaacttattgtaaaatgtacaggcaaaagcaaagaaactagagtagaaaaagaacaataatgtcagaagcatcaccaccctacttagactaactgtaaagctgtagtatcaagactgtggtattgatgaaggaattcatacatagatcagtgaaggagaatgaagagcccagaaacaaacctacacaaatatgggcagttgacttttaacagcggtgcaaaaaaagccaatcaatggagaacaggtagtacactcaacaaatggtgtttgaacaactggtcatctacatgcaaaaaaaacaaaaacaaaactgaacctcaacctatatctcacatctggtgcaaaaattaactcaaaatgtatcataaatccaaatgtaaaacacaaaattataaaactcctgctcctccagtggaaggctgcttagaataagaaagctaaatcaggggcgtggggggatggggatgatgaatttcccgctcacctaagtatgaggaccagactcagtccacagtctgactaatgctcatagttcaggcctgggatgtccctgagggtgggaacagggcccattccctccctgcatccccaacacccaggggtggatgtaagctgcctctttgtggcctctgccaggtagggggtcaggaggctgcatccttccctggccctgggagctggaacagactgctgcccccagccccctgcccccaacagcctggggcccaacagctgctgggtaattcctcagcccctggcatgtgtctgcccagactccgtaatccccagacctccacgggctcaagtgtcagttgtgcctgatcagagaaggagggaggaggaggggcggagtgatgcagaggaggagacaagggaagggaaatacttggcggccctgggaaatccacccctgcagcagctgtgaggactcatggtgcactgagattggcctccccaccaaatccacaggtatttatggagggcccgccgcaggggtcacaactggacgtcccagactcaaatgcagcccacgggcatttgcaagggccgggcatgttcaacacacccaacactcagtaagttaggacagacaccagcaatgcccggtgggtgctcactgtgtaaatacgtgccctgggcatgtgccctgtggctgtgccctgtggtcctgccctcatttgcctgctgcagatcctggcacccacgtgctatgattgatgaggctcttgtcagagccacttgaggaggcctgtgtgcacccaccagccaggacatccaggaagccagtcacagccctagttctaaaagcccaattctggccttccaggaagcttcagccgacaaagtattgatcagcccattggatgataggagccttgagctgcccaggttcctgcaagattcggtgatcctcggttccaggagcccgtcctcccagggcggagaagagcatcccggggcttctgcaggaggcaggagggtgggcttcagggcacacacagaagaccccagggcaagtcaggacccagggctgtgctctgccaccatcttggccctaaagtaggcattcttactttccacccttattacaggtaatgaacaggaccagccctttagtctccctgacgtacaaatacctggaggccctgtagggctctggcctcaatttcagccctgctcctgccatggactcccaacagcctccactgatggcaactctgtgcccaccctgcacccagctctcggctcacagtgccctcttcttcttcccagcgtctccccagggcaccgtccccactttaaggaccacaggcccaggtgcagtaactcacgtgtcctggacctcctgctgctgaggctgccgccacatgggacggggtcactccccactgcctgatcccccatttgcagccccctaaactctccaggccacacccacccaggcttggccttgctgttccctgtgctggagccccgtgtccccacccattccacccccaattcttccgggctcccccatctcctccaggtctcaggattccttctgcggcagtcccctgggacctcccttgttgacccagcacccaagactctcagtccatccctccctccctccactgtttcttcctaagacttatcccaatctgacattatagtttatatttaaccattcgcctcttcaatgtctgtctcctgtcttgaaatatcaactccaggagggcagaaatttgtggcattttttccactgctatgttctcagggcgcctggacacgccaccaggaacttacaagtactcatggatgagtgttggggaaacagatggaaagaaaaggcctggggagggaggcacgggctgacgggcagcgctggccttgggacactcagggaaccttatggcaaagtcaccgcccccagggctccatgtcttgtgccttcattcattcaccacccattcattcatttattatttcacccaaacaggcctttgctgaacacctgccctgtgccagcagctactatgggttctgtgagtaaagcaatgagcaaaacaaaccaaaattccttcaaagactttaaagttccatagtggaaggtgtttacctcgcccctatcacctcaattgggaggggtgaggagagaaggtcccaggaggaaggggtttccttcctaggcagctgtcacaggtcccggcgagctgtcatggcaggcacagcccaggacacccccagacccagtgtgacaagggccctggtaagacagggaagagaaaagtttgatggtgacagaagccagcaagaggacagagggacagaggggatggaagtggcggggtccgggtctgggactttaaatggggtgaccaaggatggcctcactgagaagcaacatctgggtcatgaccagaaggaggacaccaaatcctccctgtgagggacacgatcatcatccttattttccacgggaggctcagaggagttcagtaacttccctgaggccacacagctgctgcatggcaaagcctggtttcaacttgaaatcaggctcttgacaggctataactctgctcctctacgtcttgccggggctcttggtcactctaggtctgagtgtcctgggctgtgtctgccatgagagctcacccgggggcctgtgacagccgcctgagaaggacgcccctcctcccagggccttctctcctcacccctcccgatgttctaatgagcagggagaaaagacatcatacggcacagctagaattcattccaatattaattctgaaacctcattttcagcggataattaaattactttttaattacaaacagaatatctgtacattccctctgagtgagcacgggcgggtggggagggggaaaaatggtgccgcctggcatttcctgctctgtccccagcacacagcacccctgcaaatggtccccttcttgtcacatctgaaggctgggagcacatgtccaggcgacccacctgcccagtcaccggacaaatcccaccaatgaagccgtgttctctgctgcacgcaggcagagcatgaagcccccgcactgccgccaatagccacctactccccagcccctaaaagtgctcaaagggaggacatcaagtttccactaaaacaaggagaaaaggatcccctcgaggtgagctaaggacagcagagaccacattgcctcagatgggctgcagagaggggtctgcggtgaaggcagatgcgagctgtcctgacccaggcacttctgcaacccagcagagagcccgggccagggcacagtgtcactgcagaaagcgacagtggacggcagcctcttcccttcgtggagacacatgtcacatgtctgcagctacagggtcacagcagtgtcccctcctgctctctccccagagagcccctcctgcaccctctgggctgcctctggctggagtgtccaggctgtccaggcctgggcaggtgaatgacagaggaggctcctagaggtgcagcctcttgaccactgaccaggtgcagcctggggaccatccccaggccctggtcaccaagtttttggggcagggtggcctggtggccgcagactttggggacagaggagctgggtcagctcctggctccacggctgagcagctgagaaggggtgagtgtctgctgccagccacagctgtgccctgggtgaggagagggcccacctgggctgggggagcccagagctgcctgggcagggatgagcatagatggtgacggccacccacagcagccctgtccatcagaatccaccctctgcatgaccagccctgaaagccaccttctgttggcttcttccttctccttgacctctgcctggcccgtccttgcagcccccgtcagggggacacatggctgtcagcacagtgcagcccccgggagcagatggcagcgtccagtccccatgtcctgccccacctgcctttcacatgaaaatgggagagacagccaggcagatgtatacgaagccaggtgcactgggcagtgtggacgcaaggccatgtccccaccaggtggctggagtagctgcttgacaaatggcctctgctggtgcctgtcactcctgcagcctctgtccctggagccctgtccatcctctgcacagaaatcacacctgttatctcccctcccccagcactctgcgaccacaggatgggaacagccagcccagcctctgaatgtcccatggcctggtgagcacgagcggtccctttattttaaagtgacacccagatacccagggtgaggagcagagccgaaccttgctgctaggacgaaaacgaaacagccccaaaagggaacagctgccactgagcttcccggcccctcctctgcacctcacaaggcccggggtctcggaacagaagtggactggcatttcacccaactgcttcttcatttatttcttccttccttcattcagcaaatgctgacagggtctccccactcagaaaggaggggatgacgacagcctgctcaaatgttgttggagggccgtagctcatgcctgtaatctcagcactttgggaggccaaagcacgcggatcacttgaggccaggagtttgagaccagtctggctttttggccaacatgatgaaatcttatctctactaaaaatacaaaaatttgctgggtgttgtggtgggcacctgtaatcccagctaccggaggctgaggcaggagaatcactagagcccacgaggcgggggttgcagtcagccgagattgcaccatggcactccagcctgggcgacagagcaagactctgtctcaaacaaaaaacaaacaaataaacaaacaaacaaaaatgttgctgaaggactaacacagcttttcgtgggagtgcctggcacggcctgctggtaggagacgccgtaggatgcttcctgtctcagaacctccccagagccttgtgctggcctcattaaaaatgagttaaatttactgccctaaatttccagaatcaatggggaaaggccaaaaagcagaaaccaggatccctggccctaaggagcctccgttttctcatctgcaataggggactgggggaagacaggagttacctgagaggattctgcctgcatcgtgcgcctggagcccagtggggattggatttcccagacaccttctcttccacttctctctctcatgcctcctgatcgctctctgaaattaccttatttatttgattatttgcttattctctgttttcccagcagactgtgactcgagtaagcagagaggacttcctagaagaggggacttgagtggggacaatgggattaagagaggcagaaagttggtgggagtaaattccagggagcataaggcattcaaaacccagggcccagagcagggatatcacaggcgcagtcttgacttttgttccctcccagaggctcagacttatgccattggagaacgggtctttgaaaattaattcaatgttttattcatccttaaatgctttaaagctacaaatcaaacagtcactgggtgctttgctaaccatgtcctgggctcctgtgttgccaataactgtgctctttcacataccaacctgacctttctctgtcccaggcaaatgaatttctcccagtgttcattgctctaattgcatccacagtgaggcagagcaaacatcttctcctcctggcttgcattatgcaaaaccttaatctccccaggtttcctaaagcactgtgtgattcgcagcctcccagtccaggaaatgcactgtttgatctgccagtccatatacattagatttactggggcaaataaagagcgttgatactataaactattgggaaataatgaacgcccccccactaccagcccaagcatggacatcccatatatttgcctcttaggaaaaaaaatacgtaaggttgctgatcacaaacatattgtcagatttatatcctgtgtgcaatcaacaaaatgaagaggagagcggatttctgtctcgggcaaactcttgggctgtctggggctggggctggcccatcctgatcttgggctaaattggcctaaagaaagacccctggaaggcaaggcaggaaggtagcatgctcagggttgtagcaagaacacactaagagagagctggctttgaagcctggctatgcacctttgttgctttgtgacattgagtgggaaggtggctcaacccttctgggcttcagtttcctcacctgtcaccaaaccagacagccgagggttaaatgcagtcctggatggaatctttgttaggcagcttctgtgcctgccaggccctggcctggggtctgggtaaatagtggagaccatgataggcaggaccttgacctcagggtgcccagagagaacaggccagggaagaaagctgttgactgggtaacctcagactatgacaaggcttgtgagagtgactggggagaggacagtaacatttaccagataacagagactcaacactatgacaatggctgttgatgagcacagccctctcataccctgacctgaccgtgtaacagaaactacgaacagaaactagggtaacggaaactgttaccgtagaatagtatatctggtgaaaatacccttcaaacatgagggagaaatactttcccagacaaacaaaagctaggggatttcatcaacaccagacctgtccaaaagaaatgcaaaagagagttcttcaatctaaaagaaaataatgataatgagcaataagacatcatctgaaggtacaaaattcactggcaatagtaagtacactgaaaaacacagaatattataacactataactgtgatgtgtaaacactcttaagtagaaagattaaaagatgaaccaatcaaaaataataactacaacatttcaagacatacgcagtaaacattccaccatcattctctttttctctttctctccctccctcccttcctttctgtctttttctctctctctctttctttctttctttctttcgtggagccagttagagccataaatccatgccaatttgataaccagcagccaccagccatgggcatgctgggttttgatgctgggtgtcaggactgaatgcagccaaataaatgcattcattaacagatgtattattattaccattactgttattctttacgttaccattttatagatgcagaaactctctcctaccatggaatcagtcatcagcaagacatctctctttgatatgcatcctgtcttccttctctaaactcctttgcctggagttgagtaggaaaggtatgtcttgttcctttgagttcttaagctactgtctctcagccaaaaacccactctcctccaagctgcttggtgatattgggcagtgactgaccctgcaaatgaccttttgactttgctagtgacttcctgttgggctttgccaatgggggcactagaggaagacttagaggctggagaagaaagagaggacttgctcttttgtgtatactttctgttcttcttcttcttcttcttcttcttcttcctcttcctcttcctcttcctcttcctcttcctcttcttcttcttcttcttcttcttcttcttcttcttcgtttgtttccctgtcaatgtcactgtagtaccctcaaacacaccagcgttgttaatcagccagtgctagataattttcagccccatcttctcactctgcaaggtcccagttgctacctctgtgatacctcagtgcaggggttggttttttttaaaagggtcacatagtaaatattttagtcttgtaagccctatgatctttgttgcaactatgcgtctctggtctcgtagtcataaacaatatatagacaaatgggcatggctgtgttccaataaaactttatttacaaaaacagctcacccctgccttagtgttctctgtttgcatttcaattcttcaatacctatttaacgtttacacacacacacacacacacacacaatttttgttaaaataactagtatggttcagaaaccatagtatgaaatttacaaagcaccagattaaccatcttatcattggaacctcactccccgtgaggtgtggattgtgataacaacaataaaagtcccctgactggacccttactcagaaatcagaatcacaattatggttcacatctgtcttactgaataagtcatttaatgtacttgctactttttgttcttcaggtccaaagagcaaagtgtcattaatgtagtggaccagtgcaagttttgtacaatgaaaagatcatcaagaatctccaaagactatactgtggccaaaagcagaagaggtagcatagccttgaggcaaggctgtgaatgtgtactgttggctctcataggtaaaagcaaactgcttcttatagtccttaaaaattgatctagaaaaaataaagtatctgccaggtcaatagctgcatttgaggtgtcagagagtttgttgatttgcttaagcaaagatagcatgtcaagaataggggctgcaattcacttcaccacctgattaggtttatagtaatccacagccattctccaagaaccatctgcctctacatggccaaagaggaaaattaaatgggagatcattgtatttaccacctctgcatctttcaagtctttgaggatggcactcatctctgcaaggcacctaaaaatgctatcctggctaggagggaaattatccggggattccacttgggccttactactataacagattttactctatgagtctttcccattgccaggaaacttggaaaacagctatagagtgtgtctgcaggtctatggggtccactgtgatttgaagttgggtcaaaattccacttattatttgacttctgtaaagaaatcaggcaagaggctatgactccatagtgatagtttgtggccatcagatctggagtttttctattacgtaggtagatcaaataatgttttgatacattgcccatctacttcatgtctgaggacatcataatgaataagccattgctaaagattccctgaaagtcaaaacattgtaattaccacttcttttcttctggaaaacacggcaaatatgcccatcttgtcttcaggggataaatgctgtcacatgtcctcatcctcactgatatctcccacctggcatctcccccggcatctccaccgccctgcctggcccattcagagcagccaccacggagatttttaaggatgcaggtgctccctccttagcatatttctcgatgcctaagtgaacagagtgtctgtcagcccctctgagggcatgtaatgtgctgggggagtgatggtgcatgtcattcatggtaaagccactccaacattcctatctcccgaaccctttggatattttcccttacattgtgcaatgagcattctcctatcccactcttattaaatgagggctgccactgggaccaagtgtagttatcaaccaagtaatcggagccacttccagccttaacgaacttactgtgaaattcagaattcctagtaagtgcacccatatcaatacctttaccatgaggcagtgttatatgctgacctctttagtctaacactcttatcatctattcatacacatattctgcaggtttctgctaatgtaaattagcaagatctttccaatgttttggtgtatatgctatttcctcttagggggactttgtgctggtccccctgcaataggctgatatctgaccctagattagtagcagcaaaggtggagtctaggtagcttctttcaaggcagccttctaatgaccttgtaaggagacacgggagggaggctgcttctacttggttccttttccattaaaaaaaaatgtggttttcaatgcccactatgaaggcagatacttagtaggtttataatagatactttttaaatgaatgaataaacaacatttttttttctttgagacggagtctcactctgtcgcccaggctggagggcagtggtgcgatctcgactcactgcaagctctgccattctcctgcctcagcctcccgagtagctgggacgacaggcatccgccaccacgctcggctaatttttttgtatttttagtagagtcagggtttcaccatgttagccaggatggtctcgataaggataagggccaagcatttgaaattctattttttaatttataataaagtaacttccaaaattcagtctttccccccagttaaacctcatttaaacagaacacctgtctacctcctaagaagctcctactctggctcagtgggaagcccctacagaccaggctgggggctgatccccccaagtctccacatctggaaacatgatcccttgtacctattaggtgctcagtagatgtcggctgagtgaatggatgtggggattttgcctccagagggcttttccagagctacctgtatcagctgggcactggtcacacttcaccttccttctctgggttgcactcaaagagataaactgatcttactttcctggtgaaaatcctcttccgctcataaactgataccattctagtgaccaacagctagccgaccatgagtgtggtgggttcccgctgtcagatctcagggctgaatgcaaatccagccttgcctcaatggccctcttggtaccctcatcctctccagggaagcagctccttcccaggcaccctctataatcagtgacagcatagatgattggttgaggccttagcacgggtaatacagtcaacatcactggtgccaacctgagagtccctcctcgccttccaacctgactcaacccctgtgtggtccaagcacttgggagccacgagtttcagaacacaggctctgccccagcccccggacatgaatcttgatggatccaagccagagttctcaactttgtcagacccatgacctcttccaaagaagaattgtgcttaatgtctctttactgccctgaaatgaaagtcataaataattaacctataacatcatacacctacttaaaaactcattacaatgccctaagtggactataaaaagaaataaaaggacaataatttttaatgaaataataacttgtaataaattaaatcatatttcaataggcaaatgaacagacacagacacaggcacacacagagatataaccaatagttagatcctagccaacttctacagaagaagtttggatggaagagaagatcaggagttgcgctacaacagaagggcagaaaaataaagacacttgaatataaatattatattcggtgtacggtaaaatcttacaaaaatatcttgttttgatattaaattgatgtcggttctaggctaagatgattaaatggctcttcacacaagagcgaccagaggagaagtgaaattcgtgtgggaaacaggacggtctgtcttatgtggactgtcctgcgccttggaggcatccagcattcccagccccacccagctgaatgccagcaatattaccagtcattgagccaagccacccccacatttccatacaacctcagaggctgtacctctctggtgaaaaagcactggccaaaccatgataattccacttcctctgccagcaccaggcctaacaatgcgcttgggatgcaattttggccaaagttacaggcaatccaatctgctgggggcttctgggaaagggttccagtctcttataaagaggcactaggaagagacgcgttctttcttttgctttcacctcttgcacaagggtgggacgcctggagctgtggcgcaatcctacgagcttcagagtgcaagcctgagggtcaggccaatgtggagagcacagtgggaagttgaaaagaatcagggtccctggtgatccccacctctgtaccagccaaaccagaagtgctaggaagtccactggatttcttgattcatggagacataagatattgtccctatgatgtaagaacaataggatacttattgtggatttctctgctgcttgaagccaaaagcatcccacctgtgacaggtagagtctttttgcttattaccataatcccttctacttgataagcaaaacctttgaaatgtgcaaagcgccagactaaccatcttatcattggaacctcactccctgtgagttatggattatgatccccatgtacagacaggagcactgagaccagggaggaggggaagtgatttgcccagcgccaggccctgtgttgccccagggcagtgctcctcctctcccccactgcacccaggaagcctttgctattctgtgatctgatgcctctttgggactccatgctctaaatatctaccccaccctcatcaccatttcacattctcattcttggggtggcgtccctggattgaagaactgtgactctcggcatttcctactaaaatatgcatatctcatcttaaaagaactaatacatattcattagcacaaataaattcttcattagttctcagatatggcaggctttgaaagaaataagacatgagacgggtgagttttgagctgagttcattcatcgtgccagggtgagctttcatttactcattcactcaatgaatatttaggaggcacatcctatgtgctggacactgggctatgtcctggagccacagcctcctactctccatggctcctgccctcatggagctggccttctagtgggatggcacagtcaaaaccataagcaagataatcgcagattcgataaaccccaaggaggaacttgtacagcctgatggaatcaaatgtgactccacagggactcccttagtcagggcggtcagtgagggtcccctggtggaggagaaatgtgagctaagacccagaggatgaggaagccagccatgacaagatctggagggagagcattttaggcccagcaagtgcaaaggccctgaggtgggcatgtgcttgatgccaagtgagcaggggagggaggtgtgcagtgaaggtagggaccagatcacataggatcttggattttatttcaagagcaatgggaagtcattgaagattgtagatgacagagtggcatcatctctcttgcactttataatgctcgctctggtggctggaagaatggatcatggaagcaagcacagatcgaggaggccccataggaggctgtctcagtccaccagcttggattaggaggtcatggacaaggtgtgagccatggatggaacttggagggcatgctgtccatgggctggggtccaggatacaaggtacaagctgcactgcacaggactgtcttgtgggtgtaggcatcaggactgggaaggcccacaatgggacaggccctgctcccactgcagcacgggcctgtgagtatggcccattgtgcccggggagcctggcatgagggaagagtgacagcatgcagagcgggcagcaggatcgaaagaggccagagagaaaccctgaatccttactctatggaggactggaaactcaggagggcactgtcagatcaggcagaggacccggtgacccagggccagaccggactgtgtgccctggaatgttctgtgccccgatgccacttcctggatgtgcaggatagacactcaagagttcactcaaaagcaacaggactaaggagcattcctccacccaggctctgtgaacacctctgctctcagggcagatcctgggtcctggattctgtgcccagtttgtgggttttgttttttttttagacggagtcttgccaggctggagtgcagcagtgcaatctcggctcattgcaacctccgcctcccgggtttaagcaattctcatgcctcagccacccaagtagctgggattacaggtgtgtgacaccactgctggctaatttttatatttttagtagagatggggtttcaccacattggccaggctagtctcgaatgcctcacctcaagtgatccacctgcctcagcctcccaaggtgctgggattacaggtgtgagccatcacacccggccatacgatgcataatctatatgatgactgtgtgtgtgtttactctccaggtaagaggggaggaaataataataacagttggcactcactgtgcatttacaatgctggaggcatttgctaagcacttgaaccagctgattgctccaagtcccacgataaccctgggagggaggtactttcatttactcccctttgacaggtgagaaaactgaggctcagagtggtcacgtccaagaacacacagccagcaagtggcagagctggaatctgagccgaggcccatctggcggctcctcattctgggatcaggctgaagccactgtggggcatcggtggtgacactgagggctagggcaggtgtgcagggagcagtggcccagcagctgtaggctctgcgccctctgccacatccagccctcagagcacccattcagggtcagaacccagcatagactttaatcccgcagttctggcagctggaggggaggggatgcccgtgggcagaggttctgtggaattggcagaacccttccccaccccacactcagccacaggcttcatcctctcatctcccagctttgtctggaatggtctcctctttcgagtaaaccctactgattctgcctaattagctcttcatatgaaatccccagttactctgggagcagcctccatggcggatctccctggagcacggaggtggagacgcaggcgaacacacctctctgcaaactgaatggatgcaattggtccccagggcctgagtctaacatgggccctgggcctcactttcccagaaggcctggattcctaaatgtgggagtcaccttcaaatgaggctgcgtctagagtctcagagaaacgaggactgtgaggacccagtagcccccttggggcagtcacccacagcctggcgctgatcaaaggctttgcctgcccctccaaccccgacaccgggaacatgcggttgggagcccatgctgcagatggggaaaccgagacacagacgagtcaagtgacttgcccaggaatccaaacccaggaatccggacccagggagtccggccacaaagctcaggcactgacccacgagccctaatccccatctttacagccccctccttcccgtcctcacgcccagatgcacctgggatgaacgtacttttacaaagtcaatgtagttcttatttcctgaacagcaccacgataaagagttcgtttgttccttcaacatttcagccagcccgtggtttctatagccctttcttggcattccttcacttttaatacactggaagccccaagagggaagccccctgggtctttccttggtgacctgcttctgccagcagcgagtggggctgcgggtggggacccaggacctgggacaggacaaatcccggctcagaggctccttgactgcgtgcccctcggggagcgccttcccccttcagctccttcagctccacagtgggaggacagcgacaaccatggtgcccccctagggctctcgtgaggattcagtgaggtgatgtgcacagcctgcgacacacagtaggggttcaatcagcaccaagcatcagtgtccctgcagtccctatggggcacggggatctgcctcacctgttaatcaggaggaggaaggcgagtctttccttttctttttggagtcagtctctcactccatcacccaggctggagcggagcagtggtttgatcatggctcactgcagcctcgacctccctaggctcgggtgatcctcccacctcagcctgggaccacaggcttgcaccaccaccccaagctaattttttttctttatttttaatagagacagggtctcactatgttacccaggctggtctcaaactcctgcgctcaagcaatcctccagcctcagcctcccaaagtgctgggatgacaggcgtgagtcagggcacctggctctagactttcgtcgacgtcctttctggctcagacattctgagcctccaccatcgggtagggtcagaccttctgagcctctgccatccagacagacccagatggatcagaggagggtgcgagggtgagggtgaggcagagtgttcccagtccctctttatggccaagactctgcaaacaggacatggatctggcttggataggacacagatgtgacagccctcatgtctccccagcctcagtgccccaggaccccctgccctcttcctgacagcaggggatgtgagggaaggagggcagccctgcatcccacacccaggccccctcccctcccctgatacccagcagccacgggtccatcgtcttccagtgtcagccacgcaccatgaaaacagataccacccaccggggccattcctgtgctgtttttcaaagagctgtttgggccaaaagccagcaatgcaagtctgtgtgccctgcagggctggccctcctccagctcttcatctctgaacctcctgtccctggagcagctcatctcagccctgccagtgtctggaaagtgcccatcatcacctacagctctaggagggctctggcgaagcacaaatcaggacctgagagcatctcccgttacccatcagccccgtggcggtgacatgtgtccagcaggcagcagagccactgggaggggcacagggtgggttggctctgattggagcggacatggcaagaaggatctggaggtggaagccagggcagcagggccagctgcagggtgggggtgctcgggcagcccagcatggggaactggagcctggaaagtgctggaagggaaacattgcaggaagcaggaggacagggaagcacccaccccacatgctgggcagaggctggctagggacccgccctgggagtggatggacttgaatcctgggcccctctgctgagaccctcaggacttcgggatgggaaaacagaacagcacagggccgctgcagtgacccagggagaggagctgagccaagccaccctcacgcacccaaggacctgcccctgggccacaccccagacagagccccgggctcagggtctggagccacacggcctgggctcaaatccagccactgtccttgtgagcaaactttggctgcaataatgggaggtgcagctggtgaaggcgctggcagcggaggcatttccttagcatccctctcctaaccacccctgccccactccagccctccagggaacgctaccagtgcccggagggaggcagcttcaggcttggctttcggcctcccctgcctgcaaaccccgagctccaggcttgcagtgggagcctcccaggagctctgggcaggaggcccgcaaggctaggcggggcgccctggcccacagcgccatctagtggccgtcacttccacaaaggtgcaccagtgactgtgggtttctggtcacaagcttcgtaagcaccccgctttacagtgcataagggcctttcatatccttctcctccaatcagaagagaggaagggaaaaaagagaaaagagagaagggaaagatccccgaaaggaaagaattgaaaaatcgagtcaagctcacagacatatgttatgggacaaagacaaatatagaaaagcttagagagagagaaagaaaatgagggggacgaaagtaagaaagagacaaattttaaaaagtttttaaaaagagagaaaaaaagagaaaatattcacggcaagcccagcccaggagagggatagcgccagtgcccattgtccagacgattccaggccccgcctccaggctggctctgtcccaaatacctgcacccaggagccagccttcggtctgagtgctggagcccggggaacagcagcctctgggcactacgcggtccccagcaccacctgctggacagacagggcactacacttatcccgggaagttccactttggggccctggaggagactcctggtacccccgcaaggcagccaggtgggcgtaaagtctccatttctcaaagaaggaagctgagggtcccagaaagacagagaatctcagatatggccactcagcaagtatcaggtgttgacagattcaggagcaggcgagggtgtctgacttcaaaggtcctagtccagccccccatgaatgaacccacgtggcagacacagaggttagaggggcccgcttggccacagatgggtgtggcttgcgccccccgctctgatcactgtgctaaccctgctttcttctattaatatttagccgtgattcaccactgtctggccctgggctacagtatggaaggggtgtggttcctgctcttactgctggggggaaggtggacaggaagtacaccaacagttatttagataaaatcataaagcggtcaacacaccccatcgtaccttccacttcctgggtggcctctgttgcagtccacgccaaggggccatctctgggtcagcaccttttgacagatgaaaaaactgaggctcagaggaattcaaccacctgggccctgccctcatcctggaggagcagagaaggagaggctccgagagacgtcaatgcggggctgcgcctgccccttgattctccattggacggcacagtgactccgggtcaccaggtcctccccgagctgacatcgccatggcaagtccagagctaaggatctggccgtcagcgtgagcaggccggatgagtgctcggaccacgtggctccggggagctggagagctggcaccctcctcaagaagacagccgctcctcagctccagctgacatgtagccaggtgggaatgtggaccagtgtgaccagagcttctgattttttctttaatcttttttttaagaggcaggaccacactacgttgcccaggctggagtgcagttggctattcacaggtgtgatcaaagcgcacgacagccttgaactcctggtctcaagcaatcctcccacctttgcctccaagtagctgggaccacaggtgcgcaccaccacacccagctcagagcttctgattttcgagacaaactaaaaatcagaattcagagatgaaatttgctggttcataaatataattcatttttttaaaacaccatatcaggaaggaagtaaaaaaaaaaacccacatttagttccaagtttcagcctggagccatcagtttgagacctcttgtctcctgcaaaaatgtccgcttgctctgagaggcccttcgtgcttagttttatacttggagaaacacatctcggagagggaggtgggcccggctctccctcccaactctgcaagcacagctctgagcctgtaaagtatgcaacttgctcaaggccacagagagccggctggaaacccaagctgctcctgcctacggccccaggagaatgtatgttccttctgcgggcccccagggtggaggagaggctgaaatcgatgctttctagaaacgtgtctgcctgaaggaagacgtccaatcctccctgttgacctcaaatatagattgaggtaacaggtcttccctcgaagtgattttccctggatccaaacactggcctcagataattctaaataatcaatccatgactgtgcctgaaaccccaccaggattccctcttgcctgttagagtattgagtcctttgaaacctgtaactgagagacgcgaggatctctctctgggagggatccaatctgggccttcagagaatgtaatctgcaacaggttagtttggaaggaaaagagactgaaagagaaggggctcgagtgtgaaatggcagggctgggtgcagcaccatggtacaggggagtcccaagggtggccatgacccagaggaaactgtcatcgatttcagcattttccaaaggattggaaatcgggaaaagatggaataaagaagaggccatacgcaacataccgaaacccggtctctataaaaatttttaaaaattagccaggcatggtggtgtgtgcctgtagtccaggctacttggtaggcagcatactgaaacctggtctccacaaaaaatttaacaaattagccaggcgtggtggcacgtgcctgtagttgcagttacttgggatgctgaggtgggaggataaattgagcccaggaggtcgaagcttaagtgagtcatgatcgcgccactgcactctaccctgggtgataagagcaaaagaccctgtctcaaaaaaaaaaaaaaaggacgagggggcacagggctggcacagcagaacaggtctgcagcccagggaatgaggtttctctgactatgcaaacaaacccaggcagcttcataaagatcacctgggcccaggcaggtggagaacctgctgacagcctaggatgcagccaccaggcccaggtgtgcacgcagactctctattctcattggtgcatttcacgtctgcccaataggcctgtttgtggccagcgtaagttctggctgactgggggtccggcacgaccatgttgtgggtattttgaactccactcccgcctggatccaacaggccttgcaggttggagcgaggaggattctatggcaccccttggatccacactgtcccctcagcacaagtaagccacccaggaggaggtgtggaattcctgggaaaacagtcactttttcctaccttcacagtgaaatgggagctcagaatccaggggggaaaaaagctgaaatatcaaataaggcctgttattttcctgtatacctgggttgcaggcaatccgtgcaacctcgggtcgtcctcagcaatcaccccgcgagagaagctgcatcgccccattatcaaggaggaaactgaggcacagagtgaaaacatcactgacttcggggtcgctggttcaaggccccgatgcagagatcagcactgtcctccatgaggcttttaaagcgcgagctcatcccctagtgcccccggccgcacccaccccccaagccacccaccgcagatgaagcagatcacagcctcgttctttgtattataaactgacttttaataataataaaaaatctatcaagaatttaacgagaagaatctgtacattttaaagtaaaccagtgcacaatgcgctggccctgggccctcccccatttcccgcagcagggctaaagcgggtcctcctttgtctctgatgcaagatacagtgacaaggccactgcctgccctcgtgtatgctgcggcaagagagggaagcgcaccctggagggcgggaggctcggatgccagatgccgggagggcttcaagctcccaggcctgggggcagcagggagcccccacctgaactcaccacctgccaggggtgacaggcgtccccccgcttcctccccagctgtgacctttccctgaaggcataccgaagctggggggacaaactgccgagggggcttgtgtgggtccctcctccccagcaggcagggtggcttcctgtgctctggctggtgatgtcccaatcgccctgctctgagaagttaccatcaagaaaataaatcacagaagccaccgcccggtgtttcccagtgaccctctaacccgtgtgacacggcacctcaggtggggctccatcccctccagctccaaccctggctggccacctctcaggcccttgtagccagtcactcaaagagagcgagttctaacaccggccaaccgctggagaatggagggtgggggaaggaatcacagtcgatacctcaaaacgacaccttacaaccctaatattaacaaacaggaaacaatgacattttttaatttttcaataatttagtttttcttttgtgctcttttttttttagtagaagcaggaacagttgtcaatactaccttctgttggtcccctgttagacaacatacctttctttgaaatgtaaaatgtcaaatatataatcacacaactttagaaaaaacaaactttgacaacaccaacaacaaaaaatcccaaaataaaccagagatttcatgccatataaataaagtcagagcaaatctcgtgcccagggctggtggccccagttccaggggcggtgatgtccagagctggtgtggctctcggggatcctctggtaacaggcgtgatggaggccccgtctctcctttcccgacagagccaagtcttttccaagtccaccaagcaggttagtacagggttagggtgaacctggaagctaagatgaggaggaggagacacgtgtggtcacctggaatgtggacgttgaaggaaaccggggtttcaaaagtgcaggcggagccatcccgagggagccgggtggccccatgtggcctccatgacgttcccttgggttctggggacgcaggagccgaaggccaggcaccagctgctcccatcagctctatgggtctccagcacccctccagcttctggcaggcgtgtgaagaatgggccggcccagggccaatcagccagctcgtcatcacagcgagggtggccaggcttgtcccggaaggaggcagggaggacgctgggcaggtcccggaacgggcggctgcggaagccttgggccatccctggagaaggccagcgctgcctgctgtgtcctcccaaatcccagctccagaggccgcggcccagcgtggggcatttgggtgttcagaggtccccatccaccggcggctggcagaggcggtagaggctggggatggaggcaaagagaatgaggagaggccggggcgggccaggacctatttgtattatttccatttttacctgaacatgtaattcatgcccagaaacccaaactcacaggtatataaaagatgcagagaaaaatatctatgctgtccatgccttctgctgactgccaggcccctacccacaggcagtctctgcccactcagagactggcatttacaaatgaagacgtgtctacaggtgcacgtgtgcgttcagccatgtgggggtggggtgcacattccacactagtgggggccagatggccacagcactctgccccttacgcagtttcacttgctctatcctgggaaactctatatgcagagatggttttggagccgggggaccagacaggaggctgcgtggtgtccagggcaagcagactgcaatgctgcacatgtggtctgatgtggtcagcgctcggactccacgcccagactgcctgggttcagaatcccagcttttccatttactagctgtgtgacattggacaagatacttaacctctctgtgccttagcgtccccacctgccaagtggggatgacagccggacttggctcacagggcagctgtttggattaatgagtccacagaggggaagcaattggacagtgcgtggcacagggcaaaggccgtgaaggtattgaaaggaaccacgtgccactcgtgagacacaaacaaggtgtgtgtggagcccccagcgccacagcacgcacagtgactctcgtcaccactggcagcaggtgttgccggcgctctgtggttacgtaagacgttgccgctggcggggagctgcctgaagggtccatggaactgtggactatttttacaacttcttgggagtcacattatttcaaaacaagagttatttaaaacttgtgggcagatgacgacagcaaactagggctgtggagatggagagaggatcagacggaaacaacgtcatgatcctaaagggcctacatgtggcaccaagaggaagactgaaaaccacatgaagagagggcagggtgggaggacaggaggaaacagcactccccatgccaaagacggcaggaacagagagcattcctgcaaatcaggcatcgcaggcctgggcccaggctgctgttcagttcgcatttctgtaaatggctaaaaggttagcttaggttggatcagctaaaatcacagaattcttaattccaccccaggttaaagcgagccgctcaggggtcagggactcagggtagggggcacggggtggggggcacatggcatgggacacagggtggagggcacggggcgggggctcagggctgagagggcatggggctgagggcacagtgtagtgaggtgggaggatctcatagagtcaccgcctcacggcacacctgggggctcatcttcccggtgggagcaggagctcctttgggaggtgacaaagttgtgtctgttgctcctcaaagaggttccccataaatgagaggggaagccccatctgagcattaggggttaggccaggagcatgatgccaaagccaggcctgggtcgccagctgggagtggacaggaaggggcggacgaggcagccactcaccgcggagcaccctggggcatctggtccttgactcgcaggtttttggccagaatctccacccttgggccctggaagaaggaaccatcaggcaggggcctctgcaggttcagggcacgtgaggaagcacactggggggtgggggtggggcccagaagcccaaggacccagaagctaagatccttgctcccctccagattcagagaaggctcaggtctggggctggtggctaccagcccctcatcccaccctggctgcaagcatgccacgccctcagcccagggtgctggaggaccctgtggccaagcggcctcacctgcttccgcatgatgtccgtggcctgcatgatgcacttgggcagcaacccgtggctccgtgccaagatggccgcctgctccagggacacgctcagggtgctcctgcagcaggggagggaggacagcgggttggcggtggggggacaggggtcgggggaggacagcgggagtcagaggacagtgggtgagagctggggcaacttcctgtccctccgaggcctcccagacccaatcctgaccatcacggcaacgcctcctcctgccgtccctccccgcttgctcctcttcctccaggcagccaccaccctcactggcaggcactctggtgcttccccgtctgcagaagccctgttgagttccctgtgacattcccagtgcctcgctcagaggaggactcggtaaatatctgctgagtgagtgggggactccctgggagcctcacgacttgtcggctccgtggggtttgagatggacacatcgattcacacctctctgggtttctcaacagttctagaacgtggattctgcagcaagacctctaggattccaatcctgtccctccatgtaactcctctgtgaccctgggtagctgagttaacctcagcctccctatactattaactatgaaacagggagcatggtggtgcacagaggacctggcccagctggaggggctgtcctgggaaccacaggaagctgagcagcatcccggcctctacccactaaaggccaggagctcctccctcccctaagttgtgacaaccaaaaatgtgtccagacattgccaaatgttccccggggataaaactgcccctaggtgagatcccctaaaataggccccactactgcactggtagagaaagacggaaaggagttaatctgcatggaacgtcaatgacctaggaggcagagagcactggccccgtgaaacatttattcagcaaatgtttcttgagcacctgtctcaggccaggcactgctctagcctctggggaacagcagagaacaaaaggggcccctgccctcccagatccagccctgccctgagggagccaaggaggaaataaataccccaatgaaggctgtctggggagtgggggtgagggctgcagaggaagagagggttgggagggcactgagtggggagagtgggcacagtttgtaacggaaggtcaggaagcactctggagaaggtgacctcttcctccctgggatgagcactggggacaaaggatggaggtaggaggcaggggagcctccagtgaggtcagcaggccccataaaccagccattgctattgttaatgttgaaggaggcttccggcggaactacagggcacagctctcacacacactcactacggcgttagagaagcaggtggctccacagccctgctaggaccacctgctgctgccattccgtttcacagacagacaaactgaggtgcagacagagccaaggctctacaggcaatggcagaaccaggattggaacccagccttcctgcctccttgccacaggaccccaaactgaccagaagctaggccagcccctccccacaccccgactcagcgggcagcagctcacctctgcatgcctgtgccacacatgaccatctggcaggcccccaggcggtagcagagctccgaggagatggggatgaggccggcgcccacactcccagcagcaccaggctttgggtggacaaaggacttcatgaggcggcagagctcatccagggcattgatggggcggatcagctgtagggggtaccacacataaccggggagttggaggaggtcctcacagcccctcagcccccatctggccctcctcccccaccatatccttctaatccagctgttcctgcagctgcctcccagctcacccctctggggataacaatgcaattcaatcttctataacctctgctcaagaaccctctgtggctccccactgccctacaagctggcagtcagtgttgaccatatatttcaggtctaaccttccaacctaattctcttcacctgcccaggtgtgtccccagtgaagcctgaagaaagtgccctctcccagcctgtcaagaccaacacaagcgccccctctccagaaaaagccttcccttctgcccccagcattccctgacccccacgtggaggtgcaaggggtggttcactaacgagctgtgctgcggggacattctgccagccagagtggaaagtcccaaacggctgtgcccaccctcctcccggagcccccagctcacagccccaagacagcaccccaaaatcatcagcacattcaaggcctgcctgaccctagaaaaccaggaggccaaaagacatgtgttgagggtcagaggcaaggagcccaaggagccgaactatcgaggcccctcagagggagctgctcccagctcggagcaacggggacatgtggcaacatggtccccaacagccagatcttcccattcctccagaaaagctggaagcctctgtttttatgggaaatcttttgatttctaaaggttgacagcaaatttgaaacacataaacaaaaagaataccatacaggttacatctgtcatgaggtccaggctccagcctcagagaaatgctgtggttaataaggcggattggagtggcagagatgggcggctgccagcgaaaataaatcatcccaggaagttgggaatggggaggaagctatcatgggagacttcctggaggaggagagactgcagggtctcaagggctttggggctagaatctgctggggcacaaccctgggcctgtctgctgagtcctgactcctgagcgccccaccctgcccaagctccctgcagcaggagggcacgtggacatacctggtctatctttaccgccgtggtgctggcatccgtgggcaggttagaccgctccaggtaaaatgccctgcgagagaaagatgggaatgaggcgggggccaccacacccaccatcctcctgcccctacccaggtctcaactcctgcagccaccgtgactccgccctctgccgactctcagaatgaaatccctgagagcgcctgcaggctgtgctcacccgcaggcacctgttcctacaacagccgggggggaaagaggggcctcctgagcactcctccaatgccacccctccctgcctgcccgtccacagcagcccccagccctctgctccccaggccctggtcctgctttttctctcttctgagcacttctcaccacttggcatctcatggctctgggcttactggtttactgttcgtctccccctccagaacaggggtcagcgaacttcttctgtgaagagcccaacggtaaacattttatgctttgtgcactggaaagtctcgatcgcggccactcagctctgccattgcagcacaaaagcagccacagaggatgtgaaaatgagtgaatgcaggtgtgctaataaaactttatttacaaaacagggagacaaggagggccagattttgacaacccctgctctagaatatatgctccatgaagaacaggactttgttttgctcactgcacattcccaaacaagcacccggaacagtgcccggcccgcagaaggcctcaacatgtgtgaatgaagggatgaatgaatcatcacacaggcaggactcagagtattccacagatggcgcagaacagactgatgacagccctgatcaatccaaacagatgccagttttcagtaactgggctggatgctttctctgagcaaacgaatgaagcctcattctctcatttccaaatgatgaagcccagacccgtactcatctccctggggtcttaattctcggcctgcctctgtcacagagggaggtggtgagacacacgcaggaagggctgtgggggagggtggtaggagtgggagctgcagaacttagaagctgcctcccagaacctgtggttcctcctggtgatacctggctcctgctctcacccctcctcccctggggttctcttctgagcagccaagaccctgggagccgcacccctcactcacaggcccaagagtcccaaggtcccctgtcctagctcccaccctctgtagaatgaagccggctcctctcagtaggaaagacccactttgaaaccaaacagaccccagttcaaagctcagccactgcctggctgtgtgaccttgggcaagtgtgtacactttctgggcctcagtcgcctcctctgtaaagtgggatccatggcctgctgccattgagaatctcacgcaggcaagagtgctgtcacacagaaggtgctcaagaaagggtgtgcggcccactgcccatgctgggggtccgcctggcaccttccatgctaatgcccactccacgtggaggtttcctgactcctgcccccaacggggaccccaggcggatacctgagtttgcggtaatactgctgaactttctccagggactgcgcgttgatgtcctgctgcaaatcctccgcggcctggctgcctggagaaggcagcccctccacgttctccagcactgggaggggagatgtcgggggcgggcaggcggttgggagccggtgtgcttggtggccttggcccggcccccgtggtcctccctgccccaggcctgaagctcacctttcgtgaacagcgctgtgtgcagcctcaggctggccccaccctccaggcgggagggcagcttggagaagtggtagctgtcgaggtagaagatgaccttcagcgcctgccggctgccctcaatgtggtagaagacgttggtgtctgcggaaggatatggggcaggatgactcaccaccgaggccaaggccaggggaagccctggcacacctctccagaacagctggcacctccctgcccccaggtccaggggggcaccctgggacctccctgttctcccgactctacaggggtagcctcagacctccctgccctcctgccctctagggacagcctccagcagcccttccctctcactctccgaagaactgcagctgacacctccctttcgcctgcttcatcagctcctagttccgctgcttaattcttgaacctgatgcggactctgcctacttagggggtccacagcatttggggtcagagcttccccagcgctccttgtaccctcacccggtagcccatggcccctgcctgggaaaagctgccctcaaacagggtatacatctgattcatagccagaaggaagcgcttagggcagggggtgcaaaatatggcacccagaccccatcctgcacccatggcagacatcactcatcgatcaaagctctgcccgagccaatctcagcctggagacaggcagctgctgctgcctatcaattccaattgctactcaaagagaacctgcccttcatctagactctagtccatgcattttcagcaggagagacactgtccccaaggaggtgaaaactggctcgtgggaaggagaatgaaaacactttcctcttttaatgtataataagcacagatgcacagataaacagacacagggtatacccgtagtagtataatttcatgggggtgcagcaattaggaaaaattgactaaaaaggttttttatgaaattaaataaaatctaatgaaatgaaaaaactgagaaacactaatccagtgcctggttcctaattaaacccacatgcctcagaagcccctggagggctttcagcatacaggcctctggactccacctccagagtttctgaggccgtagttctggctgggccggagaatatgcctttctatcaagcccccaggtgctgctggtccaggggccacgctctgagaacccctgctttcagaagcaagcccagaagttcccagccctggctgcacatccagactacccagcacccagaccccaccccacaaaccgatcagaatcgctagggcccagggccctgggatcgttgcaaagttccctcaatgattccagagtgcaagcagggctgagacgcactggtctagactatgagctccaggagggtaggaatgaggaccatgttacatggcccaaaacgcagcctgacatatactatgtgctcaaaattatggacatgtaaatagatggatggatggacggatggatgatggttggatggatggatggatggatggacagatgtttggatggatcgatggatgaatggatgcatggatggatggatgagtgggatggatggatggatggacggatggatggatggatgcatggatgcctggatggatggatgcatggacacatgggtgggtggatggatggatggatggatggatggatgcatggatggatggatggatggatggataaataaatgggtgggcaggtggaaggatgggtggaaaatagacacagagagaaagacagaaagaaaaagggagaaaggggagaaagcgtggaggaaggagaggtgaggacacgagcaagggaggaagggaggatggaacttaattatggtacttatttaagccctttaaaaatcttaagttttcacatctctagggaataattttattaagaattgggtaccagtgtcattctcttttaagagctgttggaaatagccgggttcatacaaaaagaaacccctctttttccatgtgtgccccaaagttcggctctcacactcatgttggaggcatgaggtttgacagcactgagtactgagcccaccttgggcagctggcccagaggcaggggaaggacagggtgaccccagagagctgtcccttccaccccaggaccccacctctcacagtgggggatgggagaaatcactcactggccacatagttctcgtccagctgcttaaaggagaaggtgacattgtccagctctgacagcgtcacccagatgtcctccagcatggtccgttcctccttctgcaggaagaagacagcgcggaggagtctcagatgccaaccctgccccagggtttcctatcaagatgctgaattcaactctagtcggcactccacactgtgggccccctgggtgccaggtcctgagcgtgactctccagagtggatgtgaaatcatggtgtgctctgtggcttgtcctgcactttcaagggtcatagaacccatctctgccttaattcactgagtgatcctagtaaagtcactgcctctcttgcctggatcaccaaccaggcttctaacttaacctttttgagcctaacacactcaaataaaagtccccaattccttcctcaacctcccccagtcggtcccatgtcagcaaatagcaccagcgttcattcggtcatccaagatccaaacctttgacttctcagtttctctcccgctcaccctgggcctggtccatcaccaagtctgatggggtgacactaaaacatcctccagacccacccatctccctccagcttcctggccaccacccaggttcaagggtccaccatctcttgtcaagatgacaccaggtttcccttctgccactctctgcccccaaacaatacatcctacaagtcatgttttgaaaacttaacccaaattatatcactcacccagctccaagcctctgaaccctccactgcttccagattaaagtctcaggccctacagaactggtccccacatctccctagcccctgccgctcccctctggtcacaccagccactcttcggggcctttgtacatgctggtccctctaccccgcacactcttcctcacactgtctgcctggctggctgaggtctcagctcaagcgtcaccacctcacacaggctgtctctgacagagaagctgcagtgcccgccaagcttcctgtagagattgccttctccccaccttccttccctcctctgtcctttcttcttctcaagctgcttcccccaactaggaagtcagcttcaggcccccagctcccagctcagggcctggcacatcgtggtgtttggagaatgaaggaacttggcccagcatccccatgtgagaagaggaaggggagggctgagtgttccctgcttcctccctgggccccaggttgtgcattctgagaatcaagtgatggccaatctgtgccaggcaggcgtcttgtgcagcagcagccagcagagggcgctccaaggccaggcctccccaccagccagcagcaggggctccaggagccaacctcagaggcactggtgactctcaggtcctggccggatgtccagcagcatccctggcttccaccaccccactcccacctcaggccctcagttgtcacaaccaaaaacatctccagacattaccaagtgtcccctagtggggaaactgccctgggctgagagccgctggtctgtagcatggattctgttatctgtgtgtgtgtgcctccctccctcccactgggacagaagatccctgggtacagggactctgttttgttcactgctggaccttcagtgcctataaaacagcacacaggtgctcaacaaatagctgctgcgggaatgacgaggccagggggagcctgagtaagtgggcaagggctccctcgacccggcctgggcgggcaccagtgggtgggccagcggggccgccctcccgccccactcactcaccactgtggctggcgagagcagggactggcagtgcagcaggacgcccgtggccgccacctgctccagccacttgcggctggcgtcgcggctgctctcctcgtactcgccattgttgttgtagcggtagcccagggccgccagcagctgcttggagaaggtgcacacggcggccaccagggcctggcagaagatcgcgtctctgcgcagctgcagctccgtgtctgggggcagagggcaggaggccttgctggaggggcgctcccgtgccaccaggaggcccaccccccaaaaccctgggtccaggacccctcatggaacccccagcaaagggctaacatcaggccagaaattactttttggtggacatcccagccaccaaaagccaattccacaaaaatcaattctacgaaaagcaagcccatttgccaaaactgttctctcagtgactcatctgcctgctttgaaaaccaaacaaacaaacaaacatcttgtgattttcctaagggtttcccaagaccctcaccctcagccatttctcctctcattatgggattccttggccttggccagtagaatgccaatggtgctaagctcttctgccaagctgcacatgttcagaaatgcagtttagcattttctctattttggagaactatgctttcttccttcccccacctctgcccttgcccctgtccttgaccttggcatggtctgaagaactggccagtttcaagcaattggtctctcagggtcccaatcttctggaaggaattatttccaatggccggcttctggccagtgagttttttagtgaccaaatttgacccagatcctgcagtagcacccccttggctaatttctagaaagaaggcagggatagagaaggtctccaagattctcccgctacctcctcccccttcctcttccccactctctgctgggtggaagcccccaggctggggctgaaggctctaccggcacaaggccccctaacatcgtcctctatcccggggccccgtcaacatccacccaggcctgggcagtggcacaggacagggctcctggctccagtgccctgagacttgtcccttggacacaagaggaagaagcaagtttcaagtagctcttggaggggctccaggccaaagcgttgcctccccccgtccaggccccgagggcatggatggtcggccttgggtggtggaagaggccgggtatgtgccccccacacacctttaaaggcctcacctgtgcacttcagcaaggccaggagcagctggttcttcccatctggaaggagaagggagacagaaagggggacgggctgggagggggcagcaagaggtgagggcagaaccgggcccctccccatggcacctcccaaggtgctctgacccttcacagcaaagccctggcacccaaggctgtgctcaaggaggttttattgattgtcaggtaaactccaggaacccctgacctcaggcagtggaaccccaactgtgagccccatctgtacgtgcaagcctgggacacagatggaaccagcccctttaatccctgggccacagcccctgccccacaccttgttcacataagtatggtcacacacacgtacaacctagatacacacgtatccatacacacacacactcacacatcaacagacacccaagtgcatgccacacacagagacacacacatatactcatacgtagactcacatatgtacacacgcaggtacacatgcgcccacacaagcacacagcagacacacaagtgcacaccacacacgtgcactcatctgcagactcacatacatatgtacacacacaggtacacacacatccacacagacacacaacagacacacgagtgcacacataagacacacactcctaacagcctcacatacatattctcatcctacatgggcatggccctacacacgccctgtcctgcaaaaaaagctcaattcttccaggcccaacatcctgttctctttccttaaaaaagatgctcctcggcccacaaaagggcttagaaagatgtggaagggctttggatttggtttattaggtgccttcttccccagggaggactgcaggactcagggctgggcagggtaagaacgagagcagctgcagtggtgcgctcttgtcaggactcaccacgccaggcaccacggcaggactcaccacgccaggcagccaggccagaactcaccacaccaggaagccaggccaggagtcaccacgccaggcagccagggcactgagcgcatgacctatgctgactcatttaatcctcctgaccacacgggaaggaggcagcactgtgggcccatttgacacaggaagaagctaaggccagaggcgtcaaggaactcgccatgatcacacagccagtaagtgggtgagctgggattcaagccctggtggtctggacccagagtcgatgctcctcactggttacacttttggagaacaggacagatcagaagcagcagagactccgactcagaggctgccattccccgagggaacagcccagagtcctctaatctcccactgtcctggtcaaacatctccctcgtccggatccttctaacgcaggagtctcagacgcaaatgccggcaagggccaggcaggtgatgtaagatgcgtggagcagacgccaagccacagggagtggtggagactggggtgaactggaaagcacctcggccccacgtacacagagcggccgccactcctctccaccaagggaggatgggagactgggcctagagtcaccagatcttcgtgttgttcaagagcagccagaaatccaagtttctatgtgagaacctttgtcaagctggaagcagagtcacagtttttgctgctgcagcatcgaaacctatctgtgggcctgaatctggtcagtgggctgccagccggtgtccctcataccctgataataacaggaactcacacatccaatgctttggaagctgagaaagaacaggttcagccttttcaacctccaaagtcagggctttgttttgttttgttttgtttctgatttttgttttgatagagacagggtctcactatgttgcccaggtctcaaactcctgggctcaagtcacatcctgcccagggcaggacactcagctgagagagggcatcacttctcttgtcctctccctggtcatggagaaacaggggtcacagaactggatccattcctgattctctcaggttccacaccaaaagccatggccccctccccaccatgatgcaccctccctgcccaccgaccttccacatatctctgaatgttgtccaccagggtcttgatggagttggggaggttccaggggtcctcctggatgctaatctggatcaggctccggccacggattgtacactcttctttctgtttaaactctggggcaggaaagtggcatgagggccagggaagggacggaggtagtgttggagaacggtggcacaaaggcctatgtcccatcacagatcccagagctcataatcctagatcaagggagctggcaggactcctgggcattatcgggtccacagagggtaagtgtgctatttcatggtaccacacccatggcaggcattattcatcaatctcagcactccttcctgctgctctgagaccaagactccccacagctatagccaatccagtgcagacctcacaaatcaatcacggctttcctttcgtctaagcctggatgttgtagccacagaaggattctcaggaactacctcctcatagccacaaccaattgagatggcacatgagttctatccctttccctacacagaggaggaagcccacacacagagtgggaaagtgacatgccttaagtcatgcaactgggcagtgacagcgctgggacttacctctggccccaccattcagaggccaggaagaaaaaggcccctgcaaaagacaaaggctctttcctcctgcaaggtcccagtttctgagatatttgtgggtttgctgtttctgctttctgaggtccatccctgaaagctgatcctgagacagcaggatgtgcagctgagctggggagccccaagtcctcaccacttcccaccctctcttggtggcaactgcccatctgcatttctatctcctacaatctacaatgagctccttgaggtcagggcagtatcaaattcatctcagggtctccagtgcccagtacaaggcctggcacaagctggttctgggaaattatttactggatgtacagaagcatgaatggacaggtagatgatgaatgaatgggtagaagggtgaaagagtgggcacacagatggaaggagggaaggatggatggatggacagacaagaagatggatggatggatgggtaggtgggtagatggatggatgggtgggtgggtgggtgggtggatggatagatggtaagtgggtagttgggtggaggggtggatggacggatggattgatgggtgcatgggtggctgagtgggtgaatggatggatagctagatgataaatggatgagtggatggatagatgggtggatagatggatagacagtgggagggtagatgggtggatgcacggatagtaggttgggtggatgagtagggtgggtaggtgggtaaatgggaggagaggtaggtgggagaacataagaaatttcaattccttttctctcaatcatttcaagaagaaagcctcaatttggtgttggtaagcccttaacacttctttaattcacaaatccctctcttaaatgaagaacaaagagcccttggcaggcaacagtgcctaactgcggtataatgatatttcgttgccgttgtttgcatttaatttatcattatcattatggtttatcatcaaattttggcatattatgctggcttttcatatatagggagttcaataaggtcctttcaaaattaaattttttaagagtgatactttttaaaaagtgatgtcaataataagaaaaaaatgagtatggtttaaaagacatgaaggaaggctgggcacagtggctcatacctggaatcccagcactttgggaggccaaggcaggaggaccacttgagcccaggagttcaaaaccagccatggctacaaggcaaaccatgtctctaccaaaaaaaaaaaatccaaaattagccaggagaagtggcgtgcacctgtagtcccagctacttaggaggctgagttgtgaggataacttgagcctgggaggtcaaggctgcagtgagctgtgatcataccactgtactccagcctgagtgatagagtgagaccctttctccaaaaaacaagaaagaaagaaagaaagaaagaaagagagagagagagagaggaaggaaggaaggaaggaaggaaggaaggaaggaaggaaggaaggaaggaaggaaggaaggaaggaaaagaaacaggaggggagggaaggggaggggaggggaaggggaaaggtcaaaagaaaaagaaaaagaaccattcttggctcagagcctacaaaaacaggtcatggactggatgtggcccatgggctaaaatcgctgtcctgatgatcctacagtcgttcagcagtaggagggcagagctgagcattagcccgggtacgccgccctgtctaacacccttccccatcgcaggctgtcaccttggactggctatcccctcaccttgtaagctgtggttcatagggaaatgcttggtctcttcgaaagcccggctcatgactggccccttgaggagagcattgatggagtccacctgggtggcaagaagcctggggttggtttgggccccgtggccctacacactgcagacatctgggacccacagcccccgggtcatgggccctccccaggtgtgacaggaggaacccaaagttgcgccaggagtggggcaaaggtcctacctggttaaagaggtgctccaggcagccatgaagcttgtcctgcttgtcagatgggatccgcatgtcacagggcagctcatctcctggcaggaggtagaagcagcagccatcagtcattcctgccccacctcacaccatccccagcactttcctaagagggggatacagctacagaactccaaacccacaagggatgtggagtctgaagaccaggtcctggctgtgagccacagggcaaatcacctgacctctctgagcctcagtttcttcatctgcaaaatggacaacaggcactaacgcatgacaagattgtaaagcactgctactgtttccattctgcaaatgagggactgaggaacagagaaaaggacctggaggccacgtctcctgattcctcacccagctggttcagttacatcagctgtcacacccaactccttcctagagccacctggggacagtttgtgcagttgactatcttatgtgatgaaatctgtatctaaagttcaacaatttcttccattttacttgagcttctttttcttctgttaattgaagtataattaaaattaaatttttatgcacagactatctctgaaaagacacacaagactgcagtgacagtgggaacagcagtgacagcctgagaaccaagggtgggggggagacttgtcaccatgcaccctccggggccttctgaattatgtaccatgtggatacacaacccatttgcaaaatgaactgctttaaagtctgaagtaaacaagactaaaataaaaaacaatttcaggctttcagtaacgcctttaatcccagcaatttgggaggccggggcaggcggatcacaaggtcaagagatcaagaccatcctggccaacatggtgaaaccctatgtctactaaaaatacaaaaattatctgaatgtggtggcgggcgcctgtaatcccagctactcaggagcctgaggcaggaaaatcgcttgaacccgggaggtggaggttgcagtgagctgagatcgtgccactgcactccagcctgacaacagagtgagactctgtctcaaaaaaaaatttaaaaaaaaaagctgtaagtagagtatgatctaatttataaaatattgtctatgtctgtctatccatccatccacccacctgcccatccatgcattcacaggccccaccaatgagctccaaatgctggcgagggtcatttctgggggagatgataagactctcattcatttttatggacttctttttgttgtttgtttgtttgcttgtttcttgagatggagtctcactctgtcacccaggctggagtgcagtggcatgatctgagtccactgcaacctccccctcccaagttcaagtgattctcctgcctcagcctcccaaatagctgggattacaggtgcgtgcaccaccacacccagctaattttttgtatttttagtagagacggggtttcaccatgttggccaggctggtctcaaactcctgacctaaagtgatccgcctgccttggcctcccaaagtgctgggattacaggcgtgagccaccacgctcagccatgggtacttctttgaactgctctgtgtcatttggattttcggtttacacatgtatcatttttacataaaccatgaggtcaccctgtttagttgtcagcacacgcatcacaacattcatcgaacatgaagtacacagaattgaaccgtgcatgcttccatttgctccatctccatgacattcacggagaacatcagctctaagagggcggagatgtttgtttctttcgctgccgcattcccagtgcccagcacataatatgggctcaagaaatacttgttgaatgactgaatggaaggaaatcaagtacaggaccatgcaataaaacacaaaacaatataatgcagaggaaagtataataaaataaactaaaactaaatctcatggggaggagcctctctccctgagcacaggccgctgccactccactcaccagaccccatctcgtcgctgcccaagtaggagctgttacttctcacgctggtgtaggacaggaccgagtctcgattgctgttacactcgctgcaaaggggcccagagaaggggctgagtcaccctgagctcaggccatctggtcctggcacccaaaacccactttctacagtgtagacaaaacccctgggccctcaggtgggcgtgcagcccagagagggcaccgagcaccggtcctgggtcccaaaggcagggaaggccggcctggtgggttttccacgcctgagggctgggaaacgtttctaggctctagcacagaaacacagaaataggaggaagacggtgaatcattttcacgcaggtgtcactctgtccagtgtccccaggggacagccttgccctgagacacctgcccattccacagggctctgtcttccgtctcctcagcccccagcctggctggaaacctcatgaggacagggactggattggattccctacggcccaggaactcggaaggtgtgggagatcaaaacccaggatcctgacattttttccttcacctttttgaaaattaaaggaaaaactggaggacccaaaaatgtaagaatgaaatcccagagagagggcaaaatctgagactatggacatgaggctctgggggcacaaagtgccgcagcagccagatacagacgccaggcgagcagccaacgggggatcaggcagatcccttgacgactggaagaacattcacgctgcgaggactggggggaaggtctgccttctcaaactgtatcagttctgatttttgcccacaaacagttgaagcaccctctaagattccactgtaaccaccatgggcaaatgtgatgtcacctttcactgggaccacagtgctggtttatctgcagtaaggaattaaacttacccattatatggcttattacaggaaactgagttttagtctatttaaccaactagttaggacctcactgatcttgttataattaaccagtagaaaatttagatcttctcaggttaggaggggaaaaaactgcactcttcctccttggaccaaataaacataaatagtgcttgtttcagaaaccgtatgtcttacactgagtttgcaaacacaccacagaatcttgcccttgtgcctgacaacatcgtgtcagcatgtgtggggtgacactgaggcagaacagatgggtccacgtggggacaaccctaaaatgtcagctttgcaactggggagcctaagtgggtcttccaggctcaggggtctcagataatcccccagaaccacgctatcagcaacagcaccctgagcccactgcaccctgagaagtgtccactgattctgatgttgccacgggtccgtggcctcacctgtccagggccatcctcatctaacctcagccccctgacggtgacacccacctgtaggagtcgcgataactcatggtgtcgtggcctgagtcctcctggtcctcctcggccaccttgaagcacaccttcttgatgcccccatggtcactcctgtccatctcgctctcttcactgaccaggggcagggaggaggcctcctcagccaaggatgcgtcgcaggacccacccgaggtgggctctgtgatggtggacagcagcctacggaagcaaagaccttgaagtcaaagatacaggcctggccctttgtgtcccttccctgaaaatcccaccagcagctgcaggtgtgagcactggccctcctgttgggggtgggagactcgcaagttctttcacggccaagctacacaaggctctaccagaaggtgaggcaggaagcctttcctgtgaagaccctgagagcaaatccttccacctcaataggctgtagggtctcagtgacaaccattcaacctgctgttgcagtgggaaagacctggacagtgtggaagcaaatgggcgtggctgtgttccaatgacaccttgtttaaaaatgaaaacaatcagctgggcgcagtggttcacacctgtaatcccagtactttgggaggctgaggtgggctgatcacctgaggtcaggagtttgagaccagcctggccaacatggccaacatggcgaaaccctgtctctactaacaaacaaaaattaactgggtgtggtggcgggtgcctgtaatcccagctactcgggaggctcgtatgagaatcgcttgaacctgggaggcggaggttgaagtgagccaagatcgcaccactgcacagagcgagagaacccatctcaaaaaaaaaaaaaaaaagaaaagaaaagaaaaagaaaacaataggctgaagtctggactgggcccctaggccatagctcatcaatccccactgtagggtgtgacggttaagagcacaggttttgaagctagctaaaccccagattcaaatcccagtattgccattcctcaagctaattatttaaactctcggagactctgtttcctcatatgtaaaatgggatcatatcagtatctatatcttaggcttctgtgacaattaagggagttaaaatgtgtaaacaggctaggcccagtggctcacgcctgtaatcccaacactttgggaggctgaggcaggaggatctctttagctcaagacttcaagaccagctgtgagaccgcatctctgtaacaaatacaaaaattagccaggcatggcggcatgtgcctgtagtcctagtcacttgggaggctgaggcaggaggatcacttgagcccaggagttcgaggctgtggcaacctatgatcacaccatcacactctagcctggtgacagttggataaagtgctcagaacagtgtctctgctaggcgtggtggctcatatctgtaatcccagcactttgggaggccaaggcgggtgggtcacgagatcaagagatcaagaccatcctggccaacatggtgaaaccccatctctactaaaaatacaaaaattagctgggagtggtggcgtgtgcctatagtcccagctacttgggaggctgaggcaggagaattggttgaacccaggaggcggaggttgcagtgagcagagatcacaccactgcattgcagcctggtgacacagtgagacaacatctcaaaaaaaaaaaaaaaaaaaaaagaacagtgtctcgtgccttctaagtgagcagtgatgaatacgcccagctagatgcaatcccaccacatctccacagtcagtagcatgattagccccatttgacaaacgaggaaaccaaggctcagagtggttaagtgacttgcctaagtttgcacagtggataagtagcagggccaggatttgaacccaggcctcctggctctagagtctacattctttttttcccttatcatggaatatttccatcatacacaaaagtagagagaatatcatgaacccaggtatccaacaggcagcttcaacaacagccactcagggtccaccttgtttcccccatgatccccatcactttttatttccctggagcattttgttttgttttgagacagggtctcgttctttcacccaggctggagtgcagtggtgcaatcatggcttactgcagcctcgatcttctgggctcaagtcatcctgcctcagcacactgaggagctgggacaacaggtgtatgccatcacgcctggctaattttaggattttttttttatagagatagggtttcactacgttgcccaggctggtctcaaagtcctgggctcaaggaatccctccaactcagcctcccaaagtgctgaaattacaggcatgagccactgtacccagcccactggagtatttaaaacaagtccaagataacacgtaattccaccacacctacttccgcaggtgtctctaatacatacagactttcttttaaacatgtggttctcaagtgggggcaattttgccccctaggaaatctttagctatgtccaaagacacttctacttgtcttaactgaagagggattttgccaccagcatctcgtaggtagagaccccagatgctgctgaacatcctccgatgcccaggacagctccccaacaaggaataatccagccccaaatgtcaccagtgtcaagggtgagagacactgctttacacagaccacactgctcaactgtgcccaacagaaggaaggagtcctcaataccatcaagcacccagtctgtggacaaacacccctgattgtctcaaaatgcctccccacatggacgtgctagaaacctgctaagcaggttcagaggctgcatctggcaggtccgtctcttgagtctctttaatctccagcagttcctcttccccacacctgcttccccatcattcgttgatgatttggccggatgcctccccaaggtgccattgaaccaccctctgccccacatcctagagctgagtaaggagaccttgaaccttcaggagatgacagctctgtatctgctggcaagagcctcgtgggcggggctgcgtctgtgtcctgttgtattacagcaaaaggacggcttgtacagctgcctcctttctatgatgttaaaattataaagttctctccagaatctttcagcagatagttttagcctcactgatgagcgctgctatatccataatatttcattacaccagtggttctcagtcagggatgattttccctgcaggggatatttagcaatgtctgaagacatttttggttgtcacaatcaggtgagggggtgctactggcagctagtggatagacgaaaaagatactgctaaatagcctataatgtccaggacagcccaccccccactacaaagaatgatgctacccacaatgtcagtaaggccaggattgagaacacctgcccctgctcacgccggacacccccggccagcgctcacctgttgatctgggtgacatattgcttcatctccttcagggccacatccagcttggtgaagagctgcaggtaggcatcctggatctcacggtcctcctgcttgagtaggaagctgaggccccggtcttcctgaccaagggtcccactggctggcccgaagctgccatcatggagaccctggccttggggatcaccctctgcagcaggcaagcacttccaggagggagcagccatggtggtgatgcagtgctgggtgtacgacatggggttcaggtggcctgcagtggaggaagagagagctcactggaaaacagcccccagcatccactgggcctttgggcggaacaatacaaacccatttcaaggatcccaatgaaggagaaaaatgtcccttctaaatactcttaattcattcagttacttcaagaagactgttccagtctggtgctaacatgcttttaactactgtgatcttttcctgcctgcaatgcagacatgatggctggtaccccagcagatatcatccacaaggcataaagccacatctagagatgctgtcccataaagagagaaggtcatccctgatgaccatggagccgccattccagccctggacggctgaccttcagacaagttttggtttaagtatctggagtgcaacatctgaacacagtttctaatagacacacacaggtaccttgctccgggtcaaggccgatgagggagggtttgcgtccaaagcggatgctgaaggacctgcccactgagggggtggtcttggggtaggacacttccatgaggttgatgtggcaattggtggggcagaagtccaggccacacagcgggtggggctccaggggggcttgtttgaagggtgggctgaccctgctcttcagttgggctgcaaactgagaaagtggaggccgtaaggtcgtgaatcacagggcagggtctggaaatattggcccatacccagtacccactttatcctggcctaggccagatgccccacagttggacaaaatgccagtagctccaaatgagaaggggaacccctggactgtgtttcacggctcaggactgcagggaaggcctggaggaacccaaggcctcggggtgcccaccccatgcatggctccattttggctgcccctgaaccatccttgaggcattgtctctgccccaccctcagttcatgaggttcagggtcaacgtgcctctccatccctatggcgattggaaccaggtgaggcaagtgacctaagccaagccaaccagaactcccttggagttaattttctcctgggcttgctgaggctagagctatcaagggccaacgtgtccccaccacatgagaagggtttgcctgagagtgaacccagcgctaaggaaaacgaagccaggagatgcggagaggccgcactgctatgatgtgataagttcacctccgtccttttcagtaatacacaccatacattctcctgtttgtttcagctgagttgggttgggctttgtaatttacaacccaaatatcccaggctgagatgctatgtctgggacctgtggcagagaccccggagggagcacgcaggcacctcctggtagcaggcaatcctctggccaatgctctccagcttggtgtcacagatgttgcggaactcaaagtggggcatggtcacgatggcgctgctcagggccatgagccgcctgcagttctccacgaagacgctgtcattggcagcaaaggcctcgaggatctgcagaaatgtcaacagctactgagcattccctgtgtgccgggaagattttaagcggttcacccacagtgactcctgtactactcgtaataccccccgggaagtcaggtgtgttgctggcccatattgcacgggagtaaactgaggctaaagggacaagccactctgcacagtcccacgctacctagtggtgggacaaggaccagaattcaggactccaggctaagcctgaggaaatgggattcgggtgtcccacccaactccttctcccaacctttgataagagaaactggcttcaatcccccagggtagggcagggccaggcagtgcccaaggagaccttggcggtgaggccgaagcagccgcggggctccacgatcttctccagcacatggcacctgacgcctgccgtgctcacatactcatacaccacgccgtgttccaggtgcacgttgtccacagtcagggtgaccatggggctgtcctcacacaggctcagccggggacccagggacagcagtgggaaggctggaagccaaaagaggtgacatctgagcagagatcagagggagggaggaaggcgaggcgaggaggattctggaggaagccttccaggcagtgggaacagcaagtgcaaaggccccagggcaggagtacattccgccagagtagagaggcgagtggggaagtgatggaaggtgttggagagccagtctggacaaggtcacacaagccatccaaggcctggccctgaggacagagggagccatcggaaggttctcttctcatctgggggaatagccccttggaggagaggaagtcagaacagggagagccatgagcaggctactgccaccgtcctggtaagaaatgatagtggcttggaccagggagctgaaacgggcaaggaaacagattctccccgagagcccaaggaggaccacagccctgtggacaccatgatttcagcccagtgggactcggacttctgacctccaaaatttaagtagtaactgtgtgttgtttaagctgctgggtttggggcactttgctatagcagccatcagaaactgacataacatcgtgggcatcgcggccgtgcgcagtggtgcacacctgtaatcccagcactctgcgaggccgaggcaagaagattgcttcagcccaggagttaagagaccagcctgggcaacatagggagacctcatctctaaaaaaaaaactctaaaatttaaaaaattagccaggtgtggtggtacacgcttgtgatcctggctactccggaggctgaggtggatcacttgaaccagggaggttggggctgcagtgagctgtggtcacaacactacactccagcctgggtgacagagccagaacctgtctccaaaaaggaaaaaaaaaacaaacctgctggcatggaggtggactggctgggaggaggggaggggaggggacaacaggagaggacccagcccctccggagtctcagtccctctggaagctcctgtcatgccatgccccgtctattacctgaatcagcctggtcttcctcctgggcctgctcgccactggggtcctcagtggaggcctcctgactggctcgtgcttcctgggcatcctcatgggtgtggtagatccactggtacaggccctgccagaagccagagtaaggggacagccatggtgccggcaggtagggaggaggggacagggccgaggtgtgaactgcccctgggttccagagctctggaaactcactgaccaccagtcacactcagccctcaccgtgcacagtctatgctccatacagaagccaggggatgtgaaaatgtgaggcagggacatgggtgcagacacgtctctcctgtgtccccagggtctacaaacatgcctggtgcacagcaggtgcccaacacacacacactgagtgaaccagtgaatcaatcaatgagggaatctcgccctccaccagaaccctggcccccaaccaaatggagtatccactttcccaacccacttgactatgtgcccaacatgcctatgtggtgaggagagagggtctggtcacacccatttcacagctgtgaaaaccgagacccccgggtatcatggctcagcaactctggtttaaggatgcagcgggagcacaaagctcaggcccagctccctcttgttgggtcagcagctccaccctactcacaaccagtggtacatgcaggcttttctctaaagagaggacagccctcagccacccacccccactcagcaggacttctttgacggccccggtttccagtaaacttaccagggcctcttcgcgccgactccggaatgcctggaagtgctccaggacctcaggggcaccatcgttcatcacgttgctgccattgaccttcagaatgcactgaccagcacagagccctgcagccatggcctcagagcctaaggggaacaggagcacatgaggctggatgccaggcaagtacaagcagcccgctgaacactgtcccccaccacccaccactgcaaccccagacacgcgcaaggactccacctccacccctcccaccccagagccgccctctgacactccagtgcaaagaatggattgatgttcccattttgcagaagaaactaaggttcagagaagtagtagctggcccaaggtcacgcagcaaggcaaacgggatccgattcaggcccgtttcactctagaacctcgtctcctttaaagtcctgcagccgccttgtgctactgggccgcatttggcagaaagcgtgatgggctcagagaggcaaagccatgctctctaggccgaatggccagaagccaggattccaaccaggcctatgagactccaagggcaaggtttttcagctattccacaatccccaaaccgtaggtcttgaacccagggttttttttgtagttcatgtgaaaggtctggaaatgcaaacaaatgtcaagctttgcccagacatggggcaataccaggcctgaatggtgtggtggtgccaagtacagcccctggggacttgcatggcttcaaaccctggctctgccatagaccgaccctggaaccttcggcaagtcccttcactctctggaggctggcttcctcatctgtgaaatgggaacgctcataatccctacgctgagggtcgcggggagatccgacgagctaacacgtgtgcagcatttagcatcgtgcctggcactcggtaagtgctcaaggaatagcagctggtttattctttttaccgtctttgcctatgaacacctattactacccattatcagtatctctgcagatgttctgaggcaggatttctcaccaaggcactgctgacattttgggccagataattctgtgtggttctctggggctgtcctgtgcactgcagcacgtttagcaggatccctggtctacccactaaccgccagaaacaccccctccccagttacgacaaacaaaaatgtctccgggcagggccgatgtcctctggagaggaggctaagttgtcccaaggtgagaatcactgctttaggacaaaatgaaaacctactttaaaatattatcaaattctcagtaaccttctgtcatggtatgcgttttcttaatgaacacctagtaaacacacaactatgaccacacaagtgaaaaatttatgtttaaactttaaagggaggggcacttagatgcaaaaaaagtttgggggcccagtatcatagacctacttggttccatctccaagacatagtgacgcctttaatagcacacaaggaataggcaatgcagaaagcagaggtcttgaactggtggcctttcggctggatccggccatagaagtattgcggcagagcccccaaatttgcattggtggcttctcttagaaaatcaagtctggtgagagtggacccacattcctgtctggcaataaggagctccagctgaggagccactgctccttccagagtgaacatgtattttttcaccttgccatagtcctcaccactacccactgtcttccactgggatggctacccacttgtagcctgcctgaccccaacaggcatttgtgtttgcaagtcttggcatcaggcaaagaaaataagtgctgatggtacattgtctggcagaagcctagagttcagaaggctctgaactcctgccacacagacagatccaccatcttctgcacctttcccctctctcccaaggctcccactcacctctccccacagcatagacgtacggtggggcagctccacgaatctggaagcacagtgtgtccggctggtcggggattttgatgatcctgcaccaggtagaagaggcagggaaaaaggccatgaggaaaaccagcatcactctcaataaccccggtgccaacccagagactttctgccttggaaacactgggaaaattcagcccaaaatagtagtagcaccaccaggctttccagctcccaaatacagagagaaatgtcaatcaggcagagcccatgccaccaggatctttgattaagcacaacccactggcctgcccttggagcttctgtcctcgaacagaaattccagaccatcctcccacacctccatcattctcctgtcctaagacccttggaggtgagaccagcactccaaccagtcaatagtttaacaatcgcaggtgggagggtgagaagtgatctgctggtacatctcggtgctgaccctagaaaaacacccacacaagtcccctaggaaggcaggtctgggccattctgtgggtcgatccccaaagcagagaggcagcacctgccagggagggcaatgggtgtcactgctcctggagcatcagtaccctgcccacatccccgtctaaggcaggtctccaaccctatgctgcacaattgtccctcccattcccccctgcagataaagccgagctgggagcctgctctcaaaccaggtgtttccacagctttcagcagacacattccaccttggtgctttctgccacttccacataccaacccatcgatcaaccacattttccctaagtcagctcgcctttttactgaaataatcatatttaaaactttccacccctcctgtcaagagaagatctgtgttaaataaaagggaaaagtgaaaaaccagatgcataatttttcaaagacaaaatgctttgctccccggtacctacccctagcacgggtctgctcctcccacccctgctctcgcactctgctgagccaccacctcctcagctcccccgagagccacctttgcccctgacaatctgagctccacttgcagccacaggacttcgatcagaagcttccagtggctccccatgggtccttgccaggggcctccagggctggaccccgttaccctacagacctcactacccagccctccctctcactcactgctccagccccatcagcttccttctgctcttccaatgcgccagacacggtcccacttcagggcctctgccctagctgcttcccctgcctggagccctcttcctccagaaatccccttgactcccccctcatctgcttcgggtcttcaccccgactcgcagtgacgtctccctgacagccatccctctgcacactctggcccctttcccgggtttatagaaacttatctgtgccacgctcaccagcacaggctcagtgtcttacttctgtatctgcacattgtctgtctcctgcctcctcccccaactagatctgagatctatgaatggcaggaaccgcatgcatccccacgtggctggattcccagggcccaaactgccaccaagcacagagtggcactctgtaaacatctgccgaattaatgaaggtccagcttgtgttgtgtgactccaacaatgggtcccagccacgggggaccaggacagttcatgccaccccagccctcagccaccactcagcctgagagggagggctgccggacaccccgccctgggacactcactctttggccttcgtggccaccaggaggcgcagagggcggcgggagcagaaggactggttgaggatggactccacctctgaaaacggccgcaggaacaccaggtcctcattgatggagtagatcttcctccccacctgcaggccagccacctgggtagggacggcagaggacagacgtgcacaccagttactaagctccttccctcctcaccaaggaagctcaaatgtgttcagcagaagggtgctggcccaagggatccagcaggactgggtgactgcgtgctgtctgtggtaagcagttgaggggcacaagggacctggttctgcctcatgagccacaaagggaagctcatgggagggcagctgggaaaggtattcctcctgaggggaaactctgctggggcctgaccctgttgtgtggggacacgagggtcacaccggggtggccatcttatgtctgttagggcctggcgaagaaagatgaagacctgctgacccgaaccaagattcacaactgcctccttccaaccgctcacatcactggcaaggtcaacctagccgctccggccatgggtatgtcgctccttgcagcccaaagcattcctaattgccacaggggcaagctgggctccagccagcacggcaggtgcatctcccccacccacctgcacacgccccaggcaaagccggaaggccccagggctgaatcctcggccagccacaccctcactctcctaacctatcctcctgtaggctttgcatcagacagcaatgagcttatcttattcaagccactgtgactggttgcagaaaactgagacacctgcttttttcctgtacctccccacaatgtccagcagagggcagtggtggaacacaccaggagcacagccccgggactctgcactcactcccagctactgtagccactgcagacagtgggtcctggactcagtttctccacgtgagcaatgagagaagaggagtcagcgatcattccagaatctcctgggctgggctgcctcaaggagggtgaagagagacaccccgctctgccacctgcacacggtccctgccagctcccccgagggcctcacctcagccagcgagcccctctggacggacttcaccaccacagccttgttcttctcctcgatgtcaaagccatagtcctcctcctggggcaggatctgggggcccagggcagaaggaacccggtcagggagcgaggtgggcctacggccagccccaccgtggcccccacaggaccatgacctcgtcccaggtctagtagggaagtggccagatccaggtgggcgagacagagcaaaacgcaaacagcacctggcagagccagtgctcactctgtgcctgccactggcttaacgaatcacacggatccaaaggtgtccagccaccaagaatgtggagtcagggagtttagggaggagcggtcccaccccagggcaggatggcaggcatgctagaaacaggtctgggggttccccagtgcgggggatacagggaaaggcactcattcagtcaacagacattgattgagatgctgcccatcacacgggccaggcagttctcatgggtgctggagacaccatctagaacaagacaaacaagcccagccctgcttagtgcgggaggccaactataaacaaataaacaaaagaaatacaggatgtgatgcagggagtgtacgtagttggaattaaagcacttaatgggatagggcacggcaagggggcagagaaggtgctatcggagctgaggcctgaacgaaatgaaaaacaaaacttcataaagagtggaggaacatgctccaggcagcagacacagcacgtacaaaggtcctgagggaggccccaaggcactggaggataagaaaagagatcaggaggtcaggcgcaatggctcacgcttgtaatcccagcactttgggaggccgagacgggttgatcgcttgatcccaggagttcaagaccagcctgggcaacatagcaaaaccctgtctttataaaaaatacaaaaattagctgggtgtggtggcgcaggtctgttgtcctagccactggggaggcagaggagaggagagaggagagaggggaggggagaaaggggaagggaggggagagaggggaatggaggggaggggagggaagaaagaaaggggaggagagaaagaaaaggaaggaaggaaggaaggaaggaaggacgggcacgagagagagagagaaagaagaaaagaaaacaagaaaagagaaaagaaagaagagagaggaaggaaggaggaagggagggaaagaggaaagagagaaggggaggggaggggagtgagaggtttaattttatcctaagtgtgacgggaagcattgggggactttacagtgaggggcatgaaatcagagggaacagcagtccctgcagtactatgggagagaagttaatggagccgtcttcatatgagtcaggcttcagctccaaccctggcagtgaccagaaacctaacctctgagcctctgtcttgactgcctgctgcaggccacgcgttaagatgggggctgctgtggggtatgcaggatgagttgcttcaggaggccaacctctctatacagtgtacggggaggggacaggagaggcaagggaacagaaagggagacctgcaagcccaatctcttttgttaggagggtagtctcagccagtgatgcagcctggcttcttggcagagttgccccctaccacctagaatccacctattctggtactccaagctgagcccccttccctgtgcataaccagaaggtcgcccagctcccatgcctgcagggggctctggcaaggaagggacagctgctcagctgtgctcctaccagcaggcgcttggccagaatgttctccaccagcttgaagtcgttgcgaagctgtttgttcttgctgctggtcccctccatctcctcgtcagcatgaaagcggaagtactgggactcatccctgaactcgctcttctccagcactgcagatccacagatgtgcactcagtggtcagattcacagggaaagtttcagccatgtttgccaactggcaggcacaggctggaactaggccatggacacgtttggtttggcaaacactattctattaaaatggaatcatatgccaacactaacatattaggatatttcacaaagcgatctggctttctgacttctcttgaaaagtctgaacttgcctcacctgctataaaaagacattaatattttacaaagccatagtaacacacagtgtggaaatgcagtagaaacagatcaataaccagcagaagggaatagaagtcacataagaggactaagtgtttgcaggaacttagtctatgatgatgatttatgatcatagagtattctgcagatggtgcatggaaaactgacttgcccaggggggaaaaaaattgaatccctacctcacaccatatgcaacaataagctaatggattaaagacctacgtatgaacagtaaaaccaaagctaacaaaactaaatataggatgacatctttgtcctagagaagaaaaggagtctgtgtataagaccctcttgtactagactaaaattaaggacctccattcgataacaactccataggtagatggcagatgtgaaggtaactatagtgtccaaaaccaacaggaataaatatctagaatataaaaacctctaacaaatcaactagaaaaagctcagaagctcacagataaatgggcaaaggatatgaacagtcaattaacataagcaaactccaatgagcagtaatttgtgaaaaggcgctcagacctctcagaaggaaatgatgctgagacactttagaccaaaagttggcaaactcagtccccgcaggccaaatctgctccactacctgaccttatgaataaagttttattggcacacagctacggccatttgtatttgtacttgtattatctgtggctgcttttgagccacaaggacaaagttggatactgtgacaagctgtacggcccacaaagcctaaattgttactaagtggccctttacataaaaaaatatactgacgccggccagaggcggtggctccgcctgtaatcccagcactttgagaggtcgaggcaggcagattacccaaggtggggagtcccagaccagcctgacacaacatggagaaaccctgtctccactaaaaatacaaaattagctgggcatggtggcgcatgcctgtaatcccagctactcgcaaggctgaggcaggagaactgcttgaacccgggaggtggaggttgcagtgagctgagatcacgccattgcactccagcatgggcaacaagagcaaaactccatctcaaaaaaaaaaaaaaaaaaaaaaaaaatatatatatatatatatatatatacacacacatatatataatataatatatagtatgtatataacatatataatatatataatgtgtgtgtgtgtgtgtatatatatatatacacacacacacacacactgacccctttctaggacaagccaggaaaatgaataaaaataaccagtatcaaccaattggtgatctgatccctgtaacttacaacttaactgggcacctcccagtgccaggcacactggggaggcatgctaagttcatctgctccttggataaggatttgctgtgcccctttcatagacggggagactaagactcaggcccctaggtcacacagccagcagccagcaggcagcagaagggccctcatcgagcctccttcctctcctcctcctctccccacactgtccaggcaggcctgttagatgaggcagggctgagtataaacagtggacaaaggtggaaatcaaggctcggagaggtaaaggcagctgtcggacgccagtgggtgcctgaaacaagggaaaccagctgccttagccacaagacatccccctcgtccctgaagacagaggctttttctggatgtggtgactcagtggaaagcagccgggggcatttctttctttctccttagttttataggacatttcacctggaactctacctgtttgtgagcccctttctcaggccacccctgttacctttttgagaaaacagacacacaaattgccactttccccagagctggggagccaggcaccagggggccgctggcttcgactccactataaacattaagttagaagattccaggagtgggaggaagaattgcaatgttgcatattggccaaaatatttgtggaaaacagcgtggaatccctcaagtccacgagctcagccaagcgagctaccaacctcaatacctttccctcgaggctgctggtccggctttataggataatctcagatctgggttcaaatccctgctcagccccttcctgacttcatgccctttagcctctctgagcctcagtttccttgtctacaagaataacaacaggaccaacatgctggggtggctgtggggattaaatggcaagcctcagtttccccatatgtgcctaaagcaagagggccggacccctggtcagccctaaggtgggaataccttagtgtctgcaggctcagtttggccccagttcgaggcgcctcaaaaggtgccacagaggcccctcccaatcgcccatcctgcacctcaccctgtattttgctgcagccacaatcctggaattggccctttcctattttagcctatttttgagttcgtggcagggaacagaggagcagggtcacgccctgcaatttctctccctgagagcccttgaggacatcaggattgcctgggagtcaccacccagcagaatgtccacagccagcagccttcccggaatagcagctggggaggacccctaattaccctcacccacaaatgagaggttgtgcccagctgactggcgggaggctcggggctgtcagagggccccgaggcaaacagagcagcttctgggaatgaaggactttggtgagatgaggtagacacatgaaaatgccctcagctgtccagactggcccttacctgcccacctcagctggggaaactggaagctaaagagtgagtcctattcccacagaactctgggcatgctgagcgcacaggaggggaatgcaaggcctccaatggaaaactggagaaactgaggcccagagaggcatatgggcctattgggagtcagctgagtcagggacctgctggccacaaggcaggggatagatccaaaggcctctcaggtctccagcacgtggctcactctgccaagggaaccgcaaatccagcaggccgaccagggctcaacaaactatggcccggctgggtgtggtggcgcatgcctgtaatcctagctactcaggaggctgaggcaggagaatcacttgaacctgggaggcggaggttgtggtgagccgagatcacaccattgcactccagcctgggtgacaagagtgagacttcgtctcaaaaaacaaactatggctcaccacctgcttttctaaataaagttttattggcacacaaccatgcccatttgtttacatactctctatagctgcttttgtgctacaaaggaagagttaagagttaagcagctgtgacggagtttgcagatctctgagttagaactaaaaaagccaatatcagaaaggagaaacagccaaaaggccttcttgtggctcagggttttctgaatctgaccacttctaaccccttgcaaccaccaggtcccagccatatcctccttcccctggactatcatgaccacctcctcgctggcatccctgtttccttcccctgcacacaccacatgcacatgtgtgcacacacatacaagtgtgagtgcgcgcacacacacacacacacacgggactgttatctgtcctggtcatcacactctgctcccagaacctggcacggtgcctggaacaccaaagacaccacacgtgatgtcagaatgaacaaagacagaaaggagtgatgggatctgcctaacagggagagaacaggcccttaaaaaaaagagaatctggtcgggcgcggtggctcacgcctgtaatcccagcactttgggaagccaaggcgggcagatcacgaggtcaggagatcaagaccatcctggctaacacggtgaaatgccatctctactaaaaaatacaaaaaattagccgggtgtggtggcgggtgcctgcggtcccagctactcgggaggctgaggcaggagaatggcgtgaacccaggaggtggagcttgcagtgagccgagatcctgccactgcactccagcctgggcgacagagcaagactccgtctgaaaaaaaaaaaaaagagagagaatccgagctaggagcagagtgatgacggggaggagctattttagctggggttgtggggaggccctcactggggaggggtcaactgagcagaaacactgagttacctgcagggatgaggcaggcagggcaccctggcaagggaaactgcaagtgcaaaggctctgaggaatgttctagaaacaggaaaatggcaccttggcgggggttaaaggtttacctgtcctgttgaaaggacaggaaactcagggatcccccaggaccttcaaggggagaggctacatagcacagtagttgagtgtgcagcctctaaacccgcacgatctgggttctaatcccagctccagacggcctgaattctaatcccgactccagacggcctgaattctaatcccggctccagacggcctgaattctaatcccggctccagacggcctgaattctaatcccggctccagacggcctgaattctaatcccggctccagacggcctgaattctaatcccggcccagacggcctgaattctaatcccgactccagacggcctgaattctaatcctgactccagacggcctgaattctaatcccgccccagacggcctgaattctaatcccgactccagacggcctgaattctaatcccgactccagacggcctgaattctaatcccgactccagacggcctgaattctaatcccggctccagacggcctgaattctaatcccaccccagacggcctgaattctaatcccggccccagacggcctgaattataatcctaactccagacggcctgagttctaatcctgccccagacggcctgaattataatcctggctccagatggcctgaattctaatcccgccccagacggcctgaattctaatcccggctccagacggcctgaattctaatcctggttccagacggcctgaattctaatcccgactccagacggcctgagttctaatcctggctccagatggcctgaattctaatcccgccccagatggcctgaattctaatcctgactccagacggcctgagttctaatcctggctccagatggcctgaattctaatcccgactccagacggcctgagttctaatcctggctccagatggcctgcgttctaatcccgatttctacttgccatgtaaccttgagaaagtttcttaactatctgagcttctataccctcatctataaaatggggctgatgttaatactcacatcaaagggctgctgtattaaactaataaatatatgtgaagtgtctagaaagagcccaggcacactgaacactaacttttgttgtaatttaaaccggtgtccatggagccacttcgtcctccttcttgccatcttcctgcctcaggaacatctcagaactcaccccccaatacctgcctctctcccaatggaaagaaaagtcacttatctgagggaggaggccggggaaagaggcagacatcccaggaagggcttcctgcctctcacattcacaacccacctgcccactgtcccacagggcacagctcctccttcctcacggaggccttcgggccaggcctgcctcatctggccttgctgcctaccctggaaggccacatcccccccaggaagaagggcacaggaaacccatgggttggacttcaaatctagcccatgtccttccagccattttggtccccagtggacaccagaagccatttctcgatcggttcagaacgggaaggggagggaggtgggattcgtgagcctccccaaacccccgggggtctagagagccacagacctggcttcagtcctcccatactcccccaaaccatcagctccagggagcaaggtcccgggggctgggctgcaggtgggggtggttaccgtggtgcatgaagccattgttgcacagacccacgccgagcgccactgcctcctcccgagtctggcagtctccctggaatggaacaagaaggggagggtgttaggtggcagcatccgagaggccatgcatggccaacgagaagcccacaaccacccaagaaggtaggctccacgagggccaggggttgtctgttttgtttactgcagtaaccccaaaacgggtttgtgattattattttttattattattattatttttttgagacagagtctcactctatcgcccaggctggagtgcagtggcacgatctcggcttactgcaagctccacctcctgggttcaagccattctcctgcctcagcctcccgagtagctgggactacaggcacctgccaccacgcccggctaattttttgtatttttagtagagacggggtttcactgtgttagccaggatggtctcaatctcctgacctcgtgatccgtccgtcttggcctcccaaagtgctggaattacaggcatgagccaccacgcctggccccatttgtgattattattaataaactccaaacaagactattttattgtactgtgatcaataccgcaaagaaaaaatggagattttaagcggcagacaatgttggttgcctagcaacacctttcccattcctccctggtcaagaagccctcatccatctccagcctcccttgcagctacaggtggccaatgagctataagcagaaatcactggtgggatgctctggcaaaaaccccttgtccctggccctttctttctcttcctcccgcctggaacaaagatgtggtggctggaactcttgcagtcactttagactacaaggtgccctcatggctggaaacacactaaggaaggcagagcagaaagacacagagagtgtggtccccaaagatatcaggagacactccagcagctctgaaccacccacctctggacttctctcatgctacagaaacacaaaccctaatttggctcagcttccataattgtgtctctaatactagaaatcaagttcaattgctaactgaccaagcaccagctaataagacgactggggaagcctaccaggggcttctgaaaaacatcttcccccccaggtaaaagggaaaagcagcaccactcctccctgcctgggataaagtcatgtgaggaagtgatgctcaggatggtggggtgaagaatggaagattcttctgtctgctactgagcccacaaaccagccctggaaccacctagctccatgcttcttgataggtggcatctctgtaagccactgttcagttgggcttgttatcctggcaaatgaaaatattccaaactgatacaatttgaaccaaggcaatctgactcatctcaggacttcccgaaggaagtgacatccaacccgaaacgtgaagaatgaacaggcacggcccgtgtgctggaccctgcgggtttggcctttggggccaactctcccaggtgggatgtcatcttggtggggcagttgatcaaggtttgcagccctcctaggccaggctgaggccaaagggatgctccctgccccaagaacatgacacttgagtggaggaccccaaggacaaggaaaagcagcgctgattgtccctcacagcggtgtgctggacagagcctccacctgctagcttctcagcatttcccggtgccagttcttcctaaggcctcctaggcctgccctggctttctgagtgccccacctcccttcagtgagtcatcctttgttatccccccttcaattagccagggcctgtttctgttgcttgcaacccaaatacactcaatacgtcccggccaagtgtgtgacacgtgtgtgtgtgtgtgcgtgcatgcgcatgtgcaggtgggagggactgtcaagcagaggaaacagcaggggcaaaggtctggagatgggcagaagcttggagcgcagaggaaccagaaggcagcacggccgaccaggggaggacaagctgagtcaggcccgtgggggccaggagccggcactgctgtgtccccgctcaatcctaagtgctgggaacggggctgacctagagtccctgctcaatagctgtctgctgatttaataaaggagtggtcagcaggggccagattgtgtaggagcttgcagccaggtcaatgagcttgaactccaaagagaaagccacaggcaccacctagtctcactgaaacgcctcccagaatgaggagccctgagaggccccgcctgtaccctcccgtccacagccagaggggattttccaaccagaggagacaggggtgctattcagaggcagcaggactcagccctgggcagaaggcctggggcagagcctctggccttggcatttcaccacactgcctgccctggctgactccataaagacacatttctcccacaggaccccaagccagtagctggagggcctgcgggttgggaaccctgccaggggtggtggctatgagaggccatatccagagcagcctcccccacgccgtgaggggccggcagtggggaggccagcagggcccaatggcggcaggccctagctctgcagatgggaggcccggcaggcagctggagccacctggccttctgaggcgctcacagtcccagcctccccacagggtcttggagctcctaaagctaggccagcagggactctcaggtcaacagtgatacagaaggcccagatgtgccacctgaacaggaagccctgccacctccctgcagccctctgggaaggatgcaatttctcctctcccagaggaagccgccacacacgagacccctgcaacctcccccgccatgcttccctgccttgactcccccacccgcctgcccacccccaggtgccctctgcacacctcaaggcctttgcactcgtcctttcctgcacacctggaatgccctgccccggctttgcaggtctcagggccgtaccacctcctcagagagtcccatccttaactacctgaaagtagccccccaaacattcctccacccatcctctcaataaacgctcaccagtcacacacactcagtaccctgcaaggcatctgtgccaccctgtcccagtctgaaattaactcacccatgtatacattttgcttaaggtctgttgcccaccgggtataagctccatgcgggcagggacactgcctgccatgttcacctcatcatcccacatcaaaattcaaagtctcctacttggtggggcacaaaaagtggaaggaagggaagaaaagggatgtgatgggagaggggaggagggacagaaagaagggagaagagaggacctagtttgaaaactgattctgaactcacctccctgtctcggtctctgtctatagtggtggggagagtgtctccatcccaccaagttctcgtgaggattgaatgagacactctgtgcaagacccttggcccaaagcctggcacacaggcagcatttgataaatgttagctgttcctgattagttattttttcactggagagaaccactgaggaatgaagatggagaaggcaaagtggggtggagagacggagtaatgggggaaagaggtgtcagttacacaggaccccagacagcctctttacccatgaattccgagaccccataaagatgcccaaggatgcctctcaccgacccaccatgtacaaggagctgcaggatttcactcagactgtatggttgacctggagacaatcactcttattaaccccactcgacagaggaggaaacagaggcatagacagacttggcagttgctcaagcttacacagtaacaatggagactgctcagagctggacaccccccgccaccatgccatggagaggggaagtgaggctgagaggggaggttagttgcctagggttgcagccaagtttcctgttcccatttctcctgcgtctcttctcccagtagtacctcaagctgccagcctgacccccgcctctcctaccccaacccctctctgcccctgcccctgctgagaaccctgctaccatcagtacctgccatctgcctggtagtgggagcccacgtggcgggcattccaggtgcatttctgcagagccagcatgggagcatgcagatctgtgcccgccccacacctggctccttggcctggcctctgctctctcctgctcagcctgctgaccccctgccctgcatgtgacggtcgcagcctggggcatcctggagcccaagtgacacagacccagaaatcacccagtggagaggtgaagagagcaaactccagagctggcttcccccgattcaaagccccgctctgccctggccacgtccttgggcaatcccttagcctctctgagtatcctttcctcatccatatttttatttcattctcagatttgcccttgattctcctaggcctctgacacccctgagaggtggtctctgctcagactcaatcagcgatcattaataccaagcgttatgattgttattgactatgaaggcatcaggacaacccctgccacacacaaacacacagaggatcctggtggctgtgtgccctgcggcaagttacataacccaagcctcagtttcttcatcagtaaaatgggaacaactgcatttgtctcaagttgttctgaggattaaataagataatgcaccaagccgttccggagctgacagagagtgcaagttgtctctccaacggccaatgcccacctcatcctcagagtttaaagaactctgattgtctgaatagtgcctagcaagccacctcccgaagtcagaagaaatgaatcccgaggaattctaagccactatcagcaatctcggttctcttccccaggggctggtttaggggtgtatgtcagacccatccagccaatgagacctaaggaaaagaccatgcaggggaagggaggattgtaggaagtttcctcccctaatacacagaaagaaaaaatgttctccaacaggacagcctttggccatagttctgtgcagatgtgatgtctggagccatggctgccacactgtgactatgaggcaactcataagaagataccaggatagcagaacagaaaggcaggagatgcctgggtacagacggcattgttgagctctaggaccacaaactccagacaataaattatgtgagagaagaatatcgtattaataagtcaggtttcctgttatgtgcagccaaacgcatgtgtaactgatccagcagggatttaatcaacattttattttaaggggtaaaataacctagagttagaaatgaagacgtgtccaaaaaataccctcccgccctacacaattatgtgttcttcccactttcctgctaagatgcaaggtgggggtgactcctgaaatcaagacgggctgtaaccacactccgaggtcacatccttgtcacagatctctcccgcacagaaagacccacgcgggcacaccctcctcccctttccctgacccaagccgaaggccagttgcctttccaaccatctcctggaagtcatcctcctgcgtcagctccagttacccaccctgtgtccccacaccaggccaagccacagataggctgctgaagtggatggacacattgcatggtcggctacagcctttgctcgacatcctccccgtctccacttgcaacaagatgcgggtgcctggggttggggggctcaggacagagtgacagtgacgcaagctactccaaggggcctctggccgagcccacaactcctcggccagcactggccacgagaaagccccccgcatgcccagcaccagccaccaacactggaagtggcttttactggttcctcctcctccagtctctaaatgctggagtgttccagggtgaaggcctgagcctcccgcacacctgcctctttcatagcatcccagctcagtcaatggcagctcaagccaaaggctttggagtcattctctgctcctttctgtctctcacctgcaacgccctactcacccatgagcaacctattaggtccaccttcaaaacatccagaatctgaccatttctcctgccacccccaccaccctgttctcagccagcatcctcccctgctggaattctagcgttgcctcctactgccctccctgctgccagcatcatccctaaagtctccacacagagccaggggacctgtctgaactgaagccacacacactgctcctgtactccgagccgggcaggggtctgggcccttccaggagtggacacagcctggcatggtgcgcccacgcggcttcctcgccactcctctcccctctcactccattcagccaccctggccccctctctgctccccagacatacctggctcgctctgcctaagagcctctgagctgctgctccccagatgtggcctgggctcactccccacttccctcagccctctgctcaaatgtccctcctcagtatggccgtccctgaccccctgtgtaaactgcaccaccccgcccatgtgagggggagatcccctgcccccgctcccacaccgttccctccaccacattgcacctagcaccagcgggcatgtgatgtattcctcttattcttatttattaagtgtctctcctatcctcaccagaacgtaatatctgggagaacaggagcttttgtctgtcttgttccctgctgtgtctctagaaccaaaaacagcccctgatacacggcaggtgctcaaaaataattaaaaaaaaaaaagttagctaatgagctcgcttgtctaacttccctacactctcttctaacctgtgtcaaatgttacccaaaagctgacaaggagcggactctgcagtgggggctgcctgaggtctgggtgtgtgtgtaaagcccaccctctcccctgcccatccgctggaaagccccatggcatcttgcgtgcccaaggagaaagtcattttccccatacattcttgcccatcttcccatctccacaaatggtatttccatcggcctaatgcacccaaatctcagggctcatccttgattcccagccattcccacagcagtgcaacccgtctcttctatctccaaatacctctcagacccgacgtcctgttgtctccgtgagccaacccaccctgagttaggcatgggattcaccctgggagcaatgcctcccctatgctttgacaccaacaggcagctctgagcactgaaggagcttgggaaatatgaggccccagaaacgtccacagcagtaagaagtgggcagctctgagagccttgaaacccaggctcctctgggctctgactgaagcacctaaaccacaaaagaaactcccacatggcacccctgtcacctatttgtagcaaattcagaaggcgggactctgtgcagattgctaacccccccacctctgtttgtttcctggtcttactggtctcgtggtccccaaacccttgcacaatttctttagtcttctatattgcatgtaatcttgggccaccttgaatcttttgtgaaagagatgaggaatcatagtaatagttaacgtttattgagcaattactctatgtcaggcaccattctaagcactttacacaattatctcatcaaaacctcaaaacaatctaaaggagaaggtattggttttagcttcattctacaactgaggcccggacaggctgagcaacttgtccaaggtcactaacctaggaagtagcaaggctgggacttgaacccacgtctgtctggctataaaagcatgagttctgggctgactgcatgtgattctcacgagggctggggagtgtggtacaatggttagcagctctgcccttcacagacatgcaaattggaattcaaatccagatatttcaagacctcccaggacatagggtcccatatcatagcaaacatattaaaatgcacccatatttcacatttgatatctctttgggctagataacttattttcaaggatgtttctcaactttcttttgaagttatttggtgctgaaaaacattcactttaaaaattggctgtgatttatcagcacgtatcaggaatttgtgcaacatgagaaaatccaggcagcaaattgttttcaaatgaagtttttatgaatgtttaacaattaatgaggccaacataaagctgcactctgtagatgtttaaacatttatccatttttatttcacaggtttcttctcatctttgggagccaatgtgttctttttacaaaccatgaatagatattcttgaggactcgctgaaaaattcacagaaccgaggcacagtgggtgagtcccagctttgctactatgaagctgtgcacccttggaccaggcactcagcctctctgggcccacttccccatctgcaagtaggttagaggactcaaaaggataacacacaatgcctgctggggccttatccagagtaagcatccataatcctgagcaataaaggagaagagacaggcaacaggcctgtatgtggcacctgaatggagcaaacaccttcgggatattgcaccaaaactgatgcatagattttctaagcttctggtcaacccctacccactgggaacttttttgaaagtagtaacttggccaactccaaacagaggctgcagtttggtaccagaataaaaccatcttgtcctagtttgcccaagaccatcccagttttaaaactgaaagaaagccctagtgtggaagcaacccctgggtctactgaggaatgaatggataaacaaaatgtggtacagacatactgctacggtttgaatgcttttgtcccttccaaaattcttgttgaaatgtgatccccaatgcaacagtattgagaggtatggccatcaggaggggactgagtcaggagggcattaggcatcccttagaaatgggtgtgacgcagggagtctgcccctcccatccctttccccatgagaggacacagcagcaaggcagcatcttggaaacagacggcagccttcgacagacaccgaacctgccggcaccttggtctggaactcccaacctccggaactgtgagaagtttctgttctttataaattacccagtctcaggtattttgttatagcagcacaaatagactaacacacaatcaatggaatattattcaaccttaaaaaggaaggagattccaacatacgctacaacatggatgaggctttaggatggatgctcagtaaaatgagccaggcacaaaaggacaaatactgcacaattccactgctatgaggtaactagagtagtcaagttcatagagacagaaagtagaatggtgctcatcgggactggaggagggggagtggagagttgaatgggaacagaacttcagtttgggaagattagaaggtctgtggttgggtagtggtgacggttgcacaacattatcaatgaatttaatcctaatgaactatccacttaaaaattatcaagatggccgggcgtggtggctcacacctgtaatcccagtgatttgggaggccgaggcgggcagatcacaaggtcaggagttcgagaccagcctggccaacacagtgaaaccccgactctactaaaattacaaaaatcagctgggtgtggtggcgtgcgcctgtaataccagctacttgggaggctgaggcaggagaattgcttgaacctgggaggcggaggttgcagtgagctaagactgcactactgcactccagtctgggtgccagagcaagactctgtctcaagaaaaaaaaaaaaaagatcaagatggtaaattttatgttctgtgcagtttgccacaattaaaagcaataagaaaaaatctttaaacaaaacagaaagccccacactgacggacaaagcagaacactggtcacacacccctgaggaggccctcacctgagccagcagccagtccaccagcttgctcccgggaagcactgacttgtaggtcttcaggtggtaatcacggtctctgtggagaaggtgagcgcacagtgagcagggcagggcggggaggacagaggtgggggtggtcctgacttccctgcaggacgtgcccacgagtcaaggatctccaggctctctaggcattgggcaggggtccgagtctcagcccagactccacacatcacttgcagtgtgaccgagggcagggctgttccaaaccaggcctccttccacctacagagtgggaggcaggaggcagcagctccagggctctggaaactttctgtctctagcccaggagatctcagctgggggtgattttgccctcagggtatgtctggagacatttttggctgtcaagacctggaggggctagggcaggggtgctgctggcatcccgtgtgtagaggccggggatgctgctgaagatcctacaatgccaggcagcccccaacagagactcatcctggctacgatgccaccggcgccgaggctggggagccatgttgactctcacagagtggcaggggagaccctccattctttcctttcctttttcctttttgttttgtggttgacattgatgtatttaaaccaaaccattgtggaaagcccctgcaaggggctggtgtggtctatcagggccgagcagcacagaggcctgtgagtttcacggttctttcctgaggtaactgccctggcctgtgacagcatctgaatccctgccgagcctggatcccatgggttccgctaaccttgcagccgaactgcaacaacttctcagcctctgaagctgtgacaaaaacgcgcttctgtggccagtccatgccaaggctgataaagtctagttggaggatttctctcaggctttaggactgggggggtctgacaggctccacgtgcagttggtgggggtctgctaccttccccagccgcttccttctttgaggctggccaaggagccccacctgccttctggggcttgcacaagagcagcagcagaggagcccaggagggcggaggcaggatggcagatgaaagtggttcccagggcctgacatcccacggggccagcaaatgctaggaaatggtccttcctctccactcttccgagaggtgataagagctatcaggtcagaggacagaaaaatctgcagctgggataagaatcaggtcaccctctctcccttcatccacaactgtgagctttgtggtaaaaagaataaccaatctctggcgttcattatacaatgccaggagccattcaaagcaccttccgtgaatttaatcctcatggcaacccaagaggtgagagctattcttatgtccacttaacagatgcagaaacagaagcaaaagaagttaatcatctttcaacattcactgacaagcttttactgagtccctaggcctctgctctccaataggtagccattttaatttaaatttcaatcaataaggccaggcacggtggctcacacctgtaatcccagcactctgggaggctgaggcaggcagatcacttgagatcaggagttttgagaccagcctggccaacatggtgaaaccccatctctactaacaatatagaaattacccaggcatggtggtgcatgcctgtaatcccagctactcgggaggctgatgcaggagaatcgcttgaatccaggaggcagaggttgcagtgagccgagatcatgccaatgcactccagcctgggcaacagaccgagactccgtctcaaaaaaagaaaaaaaagaaaaagaaaaaaccaaacatataaaaaaaggccaggtgcagtggttcacgcctgtaattccagcactttgggaggccaaggcaggcagatcacttgaagtcaggagttcgagcccagcctggccaacatggtgaaaccccacttctactaaaaatacaaaaattagccgggcctggtggtaggcacctgtaatgccagccactcaggcaactgaggcatgagaatcacttgaacccggcggaggttgcagtaagccaagattgcgccactgcactccaacttgggggacagaacgaggctctgtctcaaaaaaaaaaaattagctaggcatggtggtgcacgcctgtagtcccagctacctaggaggctcaggtgggaggactgcctgagcctggaggttgagactgcagtgagctgtgattgcaccactgcaatccagcctgggtaacggagcaagaccctgtctcaaaaaaaaaaaagaagaagaaaattaaaatgaacaaagggagctgatatcgttgggttgtgtccccacccaaatctcatcttgaatggcagctctcataattcccacatactgtgggagggacccagtgggaaactactgaatcgtggggcagttcccccatactgttcttgtggtagtgaataagtctcacaagatctgatggtttcataagaggaaactcctttcacttggctgtcattttccttttgcctgccaggtaagacgtgcctttcacatacctccacgattgagaggcctccccagccatgtgggactgtgaatccattaaacctccttttctttataaattacccagtcttggctatgtctttatcaggagcatgaaaacagactaatacagaggacagaaagtaccaggttggtgacactttatgcaggtaggcagggaagacccctgtgatatggaggcgtttgaaggaagtgagggaacgaatatgaaggtatgcagaggaaaggcatcctaagcaaagggaacagcaggcacaaaggccctaaggtggagcccattattatccccatttcacagaggaaacggttgaggcacagagaggttaagtaactctgcccaaggtcacacagctgctaactaggagggaggttcaagctcagtctgtctggctccagaactgacacctgcatcactacactgcagtgcttcccacaatttaattcagttaatcctaatgacaaatctaaaggataggtgccactgcaagccccatttaatggagaaggagactggagctcagagaggttaagttgccagcccaaggccacacagctgagaagaggtagaggtgaaattggagcttggaaagagtaacttacttgatcaccggggtgtagaggctgtgaagacggcagtaaagcctcacaccctgaaagaaaaaaggggaggaattctgggatcaggccacatccttcacgagcctccaaatccaggctgatgggagagatggcttccaggacggggcagggcagggtaatgggggcaggggtgagttgtgggcagtggagaaggcaaacaagccaaggggcacaggcctgctctgaggcgaacccagggtggaggtgaacgaggccagctgagtcagagtcacaggggcggagggcccctaccttggacatgatgtcctccagctcacttcgggccttgtaggtgccatcgtcgtagcggaagcgatacatcacctgctcattcttgaactggtgcttgtcggaaactggagagacaggaggacctgtgacgctgggcacgccccctcagcccctcccagccacgccccccagcattggccttcactgccagccacgccccctctgcccctcccagtcacacccaccagcatcaggcttcactgctggccaggcttttttttcactgaaaccccacgaggtgggtgctatgacttccccattttgcacatgaggataccccatcctcctgctacgtgcaggaccctgctgagactcgcagcttggggtggggcatctacaggggtgagggacccagaaatgcccctgatccagcctgcactgggacccctctggctcagcatgtccttagatctagatcaccaatggatgggtggggacaagcatgctggggcctgagaccacattgctgagatttacggagccatctctatcccacaaagtcatgcttgatgcttcagatccattagcaatgcctataaggccctaaccttcaagataccaatcacctcactcctacactggcccgaaccaccttcgcctcccacctggactatcacagcagcctctttgctgggctccctgctgtcacccttggtcccaacagtctccacagggcagccagagggattctgccagcgtgttcgtccaagcaggtctttcctctacgcagagctcagcaacagcttcatagctcactcagagtaaaagccaaagaccctacaattctctataggatctcatctcacctcctggactctcccatcagccctgtgccctctgacctcgtctcctaccacgccccctcctcactctgaggcagccacactccctccctgctattccctgcacaacccacttagactctgcctgaggactttgcactggctgttccctctgcctggaaccatcatgcccacctgggtccctccctcactggtggctcaggtcctggttccaatgttaccttctcggtgaggccttccccatctcccctattcaaaagtgaacgccaacaccacactctttaccctccttccctagcacctatcatgttttactatcttgctttgtaaagataagcaagtaaagatcttatcgtcccctccaactacaaggtcggctccatgacgacaggcacgtcctcctcccgttcattgtggtgtgaacagtgcctgccacattataggcactcaataaatatttgctgaataactaaaacttaaccaaatggttcttgacatttcttgaagggacagataaaagattctactcccctgcccccaggtttttgaggtatccctgatttgctggtgcctaagaggcagttttacaagggcatccatgttcctgcgggccacactgtgcccagaaaacacggcggctgcacgaaaggataggagctgcctgagctagtggaagcatggcacagttggggtctgacctgttcccaccccttggcccagctgggcccagccctccactcaccatggtggatgatgccattctccaacagggcttggcccaagttgactccttcttccgtcttgctgatttcaccaatttctaggagccaggcaacgaactcactgccaggaacacaatatgtggttgagaggatttccccaattctgggaccacaggaatcagcactaagctggcctggccacatccacccctgggaatgacagctagaacttcccacagggaagccgagtgtagtagtctatagcccttggggttgtactgaggcttcatgcttattaccaatagcagagaggagagtgtgaccagattccaggtctgcctcaggctcactggatggatgcatggatggatggaaggaaggaaggaagggagagagggagggagggagagagggaaggagggaaggaagctgggcaggcaggttggtggatgagtgactacatagatggatggatggatggatggatggacggacggatggatgtccggccagacagacagccagcagcacatgggcaggtaggtaagtgggtaagtggatgaatgaacagacagatgacttaatatggggtggatgaagaagagagtgagtagatgggtggatgggtcagggatggatcacagatggctagatggagtggtggctggacagatgaacagaaggaatggacaaacatgcaggaagaaataatagggggccagaaagatgatggcggggagtcaggcgagctaacagtgatgaaaccatgtcatttccatattcaaaaccctcccacaggcttactactcacaaaaaaaatcccaactcttcccacacggacataaacaaggcccagcatgacccactcccaccctgactgatctcacccccaatacctctcattagttatgcctaagccacacctaccacctttcccttattaaaaaataccagactcctccctgcctcggggctgctgcacttgctgttccttctgcctggaatgcccttcctcagctcttcatgcaactgtgccttctcatccttcaggtctcagcacaaacatcacctcctcagagaagccttccctgactacctcatttaaaatggtccccgacccctatccaatccatcacatctctgtgttgcttccttttttgcacttttcactgtctgaagtggtcttgtttacagatttattttacgtatttattggccatctcccccaaccagaatgtaatgacatgaacagggtgttttctctgtcttattcatggcactatcccagcacctaccagagggcctgatgcagagcagggctcaatgatcatttatggaacaaatgaagtaatgaaccatccgacagaaaggaatgttctgaggtcggcaggaaggtctcggggagacagaagtgctcccaggccagaggaagacaggcagctttcccagctcccacgtgactgcccggtggtgagaggctcagccggggccccaggtcctagttcttgcgggtgcttctcaggctcagcccagagctcaacccactcaaactcagcaggaaaagggagagcctggaatggggctgtttccgccgaggcaatctgtgttcaatgaaagcaggtggcagctggccagagcctgagcaccctgcttatcgaaaccagctgtcccgcctccaattacagggccagaggggggcagggctatttttagcttcctagtgtttggcagagcaaagacctgcctggtgtgtaggtagcggtgcgtgctggagcattcagaatgccctggctggaggcagagtgggctgcagaagaaatgcatctgctttgtgggacaggcgccccaggtggggaagggattgttctgggtcctgtccacccccagttccattctcaaagtcttggaactcagggacagggagaatgctgccagcagctgaaggaggggaacagatgtttgagtgcccactctcggaagcccaccagctgtctaattgggggccgcctctggcactgatcagcaactctctggccagggttaggggacaggaagtatcccacagcagctgctggggcagaagaagacggcccagaggacagcaactctgccctacgtttctgcccaaactgggtcttgccatcttctggtggatcaaggagggttcacagcttgctgggcaaagctgggcgggtccctgtgcctctctgggcctcatcagggcccacctgggaagtggctcactcagtcaccttctggatttagcaggcaaaatttctagtcatatgaaatcctgagctgggatgcagtatgcaaaaacccaataaaattcatctctagtgcaggggtctcaaacttgtaaataggcaaaacaggccaggaggagactgtgcagaaccagccggggcctgccgtgtctaaagctggcagccactcttcagtgtagcccatcatggcccattatgttagaagacgaacgcatctaacagcttctcgggagagtgaggaaatccagcatttcctgtgaaatctccccatcattaaatgttcatatcgagtccaacattttctgaaagcactacgtgggccgaggaaaacatgtctgctaactctatcaggtcagtggggcactgctagccacctctggggtacaggggagagtgttctgggcaaggggatcagcgcacacagaagccctgagaggtaaggtcaggaaaccagcgatctgccagtggggaggggcgctggcatgcaaagggcagctaggtccaagctcccagaaagacacagctcaggacagtgtgaggagagctggagatacaaggagaaggcaatctagcttgatgggcagtctgagagtcagggatggcatggtgagctgagagttaggatgtgtcagctttcatccctccttccttcccgcctcctagaatcattcacccactaaacatctatttagcctacaatgggccacggccagggtgaggcacaaggaatacattctgcagtcttcctaagaaagccgcctgagctcaggcccaaggtaccacttatgacccaacacaagaatcccttgttcttgcctgattcctccatgggccgtgggctccaagagggtagggactggggggtacccagtggaatacccatccctgtgactccacggctcagggatgcctcctggagatgacaatgttggacaaatccttaccgaccctctcgtgcacactaacaccctgcacctgtgcgtacaggtggccaagacaccaaggccccttccaccttggagctttccctctggcagacgtccataactgaacagcatctaatctctgccaagggtgaaacccaaggccttcgtccaggaagcttttcctgacggcccctgccagacacgccgcgtcatacctggtaaccctgagctccgacagctccaccaatgccctcgatctggatcctcatctcactccactaccgagactcctccagtggcttcccacagcaccaagacggaaatgtgagctgcctgccaaggccctgcctgaggtgacccactttaactgctgaggccacatctcctgcccctctgaccactcaggctccagccacaatggcctcctcctgttccaccatcactcaaagctcactgcagcctcagggctttcgcgcctactgcttcctaagccaggaatgctgttccccacaccctctcatggctggctcttgcttgtctttcagatcgtggttaaatgtcacttcccctgagaggtcctgactgcccactcttctgaaccagccccatttcctcttgtcctgacttcacgctaagtatttccttagcgcattcatcaagttgctgaaattcccttctttctatctgtctcctcttctgttgtctgatttcccccactggatgcttacctctatgagggcagggacttcatctgtcctattcccgactggcacatagcagggactcggtaacactgagtgggtgaatgaatgagtgaatctgttttgtctcccctactaatctgacgatgccagagggcacaggccatgctcctcccaggacaccctccacattaatacacacagattttattctttgctttttaaatgtggcatctaagagatttttctctgagtagggcagaaagaggcccctccttcatacactcatcatgcacagccagtacgattcccacgagtctcaccagcactgtgctgcacacgtcacgtgttctctcactgtatcctccgacagtcctcagaggcacattttattatctccctttaactgatcgttcactgaggttcagagaggttaagaaacttccccaatgtcacacagctagaaagtgagggaaccaagacttgagtccaagtctaactcaaagccaacccttgggggtgataaagacaaatcaggccaggtgcagtggctcacgcctgtaatcccagcaccttgggaagccaaggcgagagcatttgcaagacccccatctgtacaaaaaaaaataaaaattagctatagaagcctagcacagtggcacacacctgtagtctcagctactcaggaggcaggaagatcgcttgagcccaggagtttgaggctacagtgagttatgatcacaccactgtactccagcctgggcaacagagcgagaccctgtctctaaaaaccaaaagataaatcagacactttttatattcatgcagttccctaacagtggagacagatgtagagagaggaactgctagggaaaaataaaatgtgctgagtagaaataaaaatgaatagacaggcaaagtacagtgggagacagcaccagtgtcgctttgtgatcttgtacagaacccttcccctctctgtgcctcggtttcctcacttttaaaatgggggtagtggcagtgactgtttcacggtgttgtgtggggattaaaagacatggctgaatgccagcacatgcagcaaagggcttgatcaatatctcggaggctaccaagtccttctaccctggaggaccagggacgcatcttggacaagaagattcagtagcgggaccctggcgggggtagcaggatcacacaccctacggctgtgtgcagagcaaagccgtgcagggagaagagtttatcagaataatctcctgcagaaaggctggccctttcggacctgcagttacaaaacaagctgctatcttggccccatttcaaatgggcagtaaaagaaatctctctaatccttcctgaggaggcagaactcctcgaagttctgatcacagacaggctgcctcatcggtccggactgagcagtttggcaggagatgggaaggttctctggccccagggggcccggaagcaggcccctcctgagagaaaaacctcctttcctgtgggattaggagttggctgaaaaggccagccaggctgccccgccccgcctgccccagccagcaggactccaaggcccaaactctcctctccatggaagctcagagctggagttcctgatctttgaggaaaatagggcaccaaggcccttgagggcaacagggcaatagagtccatggcgccctgcaggtttgaacccttctacttgctgcccctccaccacaagcctcaggccatgagtgccagctgtccccaagtccacactaagcctccgtggcctgcccaacatccatactgcaccctgaatgtctatcagcatttcagcctccaccgggctcctgctccttcccagggacctgctcctgcctccccgcctcttcctccccttggcttccggaggagtgccaccttctcgccagcagctccactcagaggtctctgccccctcctccttccaatgccatcatcgggccccagggcccaggcctgcctcttctatcccttcaggttcccctgcacagttcaggccgtctcatggctttaaagaccatttaacaccatctcccatgtgtaggtccccaatgcagacctttctccccaagtcaagattttgcaaccaaccaacaagcccacatctccatgtgggtgtctaccagcctgacataacccgtccacaactgcactcgtgggcttcccacggccccctgcagcctgctcctcccgccatcttcttctccttctcaaaggagcaactgcagctttccagcgccttaaagtcctgaactccctttacttttccaccccatcagcaaatgctgttgcctttcaagttatccagaacacagccactgctccctgtctccacaatgaccatcctggctcaagcctggcccacacaacctctcacctggtccacagcactgtgataaagtggcagcttttaccctaggcctctgcaaaggctttagggaagttggggggagtttaagtccttacattctaaataaagttcccgcattgccggcaaacctctctccccagctgcaccacaagcttcatgaggttgcaagcccttggcactgtcctctccggagtgtctagcacattgtagggccttaaaacagcctgaccattttacaaggactggatttcttctacctctcccgtgccccagccctctccctcaggtgacctgcgtgtaagagccagcctgtcacacctgtgttctgacccctttgaactccagttataaaatggggctgtatttcccaaacagagaaagtggaggctctgggcactgagaagtttatagaagcttccctcgcccctcacatgtaactcaggaagagacgcctcaccagatactctccctgccaacaccctgacctaggactgccagcctccagaactgtgaagcaatacatttctgttgtttaagccacaccagttttgtgcactttgttatggcagccccagccaaaaaaaaaatggggtgggggtggggggcctacctttattcttccagcccttaaaacacctttgtaatcaattacctgtgttcaatacctctctgcttgaaatgcctagagtggcttctcttttcccaagtgctacagcagcatttttcaaaccgttagtgctttgtgaaacaatgtcatgggtcttgccagcattaattttgaaatgaatgaagaagcaacttgaatagaatagaaagaacagaagagaacagaaacagatattttcagagtgggatcaagcacagtaagctctgtgaaacctcagcttcaatcatatattacatgaatgggtgtaccaggtcacaatggaaaattatgtctggtagtaggttgaaagacctgatttagggaccccactagccttcttgatctctgagggctgctccataaggattcaggtccttttgtcactctgcccaggatggctcctgggcagggccaggctgcatgggtggatggggatgatctgccccacctccagctgagagcccagggacccagggagttcagagtgaggctactcacttgccaagaaagcacttggggacagtgctcagctttctccggcggtccttgatgaggttcaccttcttgttcatcatcatgtggtacagcttctcccccttctccgcaatcatgacgtaggcatcacgctccatgcccagcttcaggcctacacaggggcacggtcagcactggagagagcaccaggcccagggcagggggggtagggggagacaaggggcaggcccacagctcctgaaagctggcctgccacctgccccaccacctgccctccaccaccaccacgccagcagcagctagagggcactgactgtcgctgccctaggcacctgccaatgacacctcaaaacaaccattttacagatggcaaagttgagacccagagaggttaagtcctgggatgacagggggtcatgccttcaacccaggaatcaagctctagtgctatgttcttcatcactttcctatgctgcctccccaacctgagggtgggtttctagattcacaggttatcagaaaacttgtcagtatctccattccagcccagtgataaaagtctggtcgttcttccagccaacactcataggacctgaccctaatctctgcccacatttttctgttttgacccccatctaattttgacaacagcaaatgcttttatagcacctactacatgccagtacgccacatgagaaacccgcaataataaggtgccataattatccccgttttacagataaagaaactgaggtccagagaagttcggttctctgcccaaggttgcccaattggaagtggtgaaaccagaatttagacccaggaagttggttccatattcgtgctcgtgaccaccccagccctgaggtcaggatgtggacaacacccaattctaacaactaagacccacttgggccacatccccacccgtgatcccatgtgcccaacaaagaccacaaagatactgatcggcctcacctaggccacatccctgaaccccatcccagtcctgaccacatactcagccccgatcaatttcagaagtcacaacactgcctaaccaggcccccagttcagtggtttatcgggcctaatatcattttaataaatgttggtgcaacgtttaggatcagaaaatgccacctaaaaatccagatgtctagttcctctagacaaataatccatggatttggccccgctgggcccatattcctgagagaggatggtggcttgtcttgggtggaagtagggagaagagaggagaagcggatgggtgtgacatatatgtgaaaggcagagttacagggacttgttgatctattgaatttggggagcaggtgttgcaggggagaccaggggtgatacgaagagtttgactctgagctgtggggcgaagggaggagccactgactggtatgtagcagtcgaggggaagagcaggtttggggcagaaggccgggggaaatgaagagctatgatttagacacagcaagtgtgagcatctacgacacctccaagtggcaatttcaagtaagcaggatacacatttggagaaaactgaggcccagtttcctcctcagtaaaactgggaggtggggagggtttttagggttatatgtcagattttgaaatgtgctcaaatccaagacctcctgtagcattgcaaccctctacagcaggaacttggatccccatttatcagatgagatcactgaggtctggaaagctggagtaacttgccccaaaacacaccaaagcctccttttcccagcctggtggtctctgcacaaaacagcccggtgcctccacacagttgttgcacgcccacccccaagcccaccctccaattatatccagcccctgcacttcctcatgtgaactgcttcgggggtgcctgtgcccagagggactcctgactgaggttaatgggcagctccaatggaccctcctcccagaattagattcagtgaatatcaaataaaacctcaggcggagggcacagggctatgcgcaggaaaggggagcatcttgagtcctaatgcttaagggtgaagaccttcgggcaagacccttcttttgggcctcagtttccccatttgtctagtgggcaatctctgaggtaccaccaagttggaatagtcccagagctccctgtcccttcaaatacctgcttcttacagctctgatcctcctgaaaaggaccctatgccccttccctagacacagcccccactcagaagaagccacgcatagctcagggatcccaggcgagcaccccaaagctgctgctcactctcgcgctgctcccgctcgcggatgatggcatccagccacttctgcttctcctctgccgtcttggccatgcagacaaaccacttattcttggccgtgttgtggatcttccagccgttggtgacggtatagccgttgctatggtaatccgctggtgggggcaggaggcaaaggtgcagcagagactcagccgcgtgaccttcaacactccccattgccaagcccttccgccccagcacaggcagggccctcgcctggatcaggatggggagctggacttccagcccttcaaacgctcacttcttatccttttccagtgggcaaggaagaccttctgcaaacaaagacccctctcaaccactcaatgacagggggcttcattttaagaccttgcatctaggcacaaacacagcagtgactcatggggagacacttgcttggagccccaaaatgcttcctgggctcctcccatctcactcgggcactggagttacttaaaaccttagtgccagcctgacaagccaagtcaaacgtgggacccttacccagtgctggctgggatgggacctggaaaacctctcaaacagattggcatgatctagggaagcgaaagcctgaatctgaggagggctccacgggcttcatgagactgccaaaggggactgtggctcaaaaccaagcaagaacccctgctctggacaagctcaaaagcacacatactaggagatgctcacatgagccatcagtgactgcatgactgtgagtggtggcaacaggccaaacatccatcacccaaagaatggatgaagtgtgaaatgttcacgtgacggaacactctgcagcaatggaaaccaacaggctgcaaacagctacatgcagagacatggatgaaccccactaacgtggtgttgagtgaaagcagtttgtttaaaaaaaaatgtagaccatattttctgggcggggagactaggtgtcgctctgtcacccaggctggagtgcactggtgaaatcatggctcactgcagcatcgaactcctgggctaagatgatcctcccacctcagcctccacagtagctgggaccacagttgcacgccaccatgtccagctagtttttgtattttttgtagagacaggttttctccatgttgcccaggctggtctcaaattcctgggctcaagcggtctgcccatctcaacctctcaaagtgctaggattacaggcatgagccaccacacccagccgaccatattttatgaccatttaagtaaaatggtcatgaccattatatgaccaggtgggctgtatatacatgcacatatataattacatatatgtaaagccacttaaacatatgtaatcatgtaaccacttacataaggctcaaaaatagaaattttaattaaaatgtttagtcataaatgcttaggaggtaaaaatgtctttaaaaagcaagaaaatgatcatcacaaaattcagacagtggttacttctagggggaagaaggcattgcaaggaggaaggatttggggtgcagtgttttatttcttaacttgaatgctaaccacccagatgttcgcttcatgcatctatgctctgggcacttttctgtaggtagattacatctcatgataaaagaaaaaaatatatttaaatgaaacagagagagtgccagggagcaggcagggctcaggcagggctcaggcaaggctgggggaggggctacctgtcccatcttccacattctccacctccatgacttcagtgttgattcgacccctgaagatgtagagggagccgttgatggatttggtcctcttggtggacttcttgctcccggtgaccctgatagacagtgagaagtcagtgtcccctacacgtcacctcccagatgcaactgttttcaacagcgcaaaggggaacacaacactgaggggcatccaggggacagagaggagccccaggtaggggtcaggagcaggagtgtttggctggtgctggggtaacttgaacaagtcacttctcttccagccacagctttctcatctggaaaacaggctaatagccttgctgaccccacaaagctacttttcagctaaaaggagacatgggagaccaacaggaggtaacagaaacccattcttcttggctagaaaatgaggaaagacctgttaagtttctcaaagacaggaacttcctgaaatacgaccagaatggaaggagggcttggaactggcagtccgtccatccatccatccatccatccatccatccatccatcatccaccttcccagggttcaatcattcactcgagtgaattctatcattcacccactcctatagtctaaatgttggtgtccctccaaaattcatgttatatcctaacccccaaggtaatggtattaggaggtagggcctttgagagatgaagaagtcagggggaaaaggacctcatgaatgagattaggcccttataaaagaggccccagagagctggctcgcctcttccaccacgggaggacacagcaagacggcaccatctatgaagcagaaagcaggccctcgccagcaccgagtctactagcacctttcatcttggagtccacagcctccagaactgtacaaaatacatttctgttgtttacttattttattttattaatttattttatttttttgagatggagtctcactctgtcgcccaggctggagtgcagtggcatgatctcagctcactgcaacctccgcctgctgggttacaagcgattctcctgcctcagcctcccgagtaactgggactacaggcatgtctcaccacgcccagctaatttttttatatttttagtacagacagggtttcactgtgttagccaggatggtctcaatctcctgacctcatgatctgcctgccttggcctcccaaagtgctgagattacaggtgtgagccaccgtgccggccttattttatttatttatttttttgagatagagtctcattctgtcacccaggctggagtacagtggcacaatctcatcccactgcaacctccacctcccaggttcaagcgattctcctgcctcagcctctcaagtagctgggactacacgcatgtgccaccatggccgggtaatttttgtatttttagtagagacagggtttcaccatgttggccaggctggtctcgaactcctgacctcaagttatccacccccctcggcctcccaaagtcttgggattacaggtatgagccaccacgcccagcccgaatttctgttgtttaaaaaccccagtttctggtattttgttatagcagcctgaagggactaaaacagtcactcaacaaacatctggccagagcttcctatgaggaggataccaagtcaggagccacgggaagtcactcatctgtggatccaacaagcatgtggagaacgcctactatgtgccaggcactgttttaggtactggggttgcactgctgaacaaaacatctctgggaactcaacttctaacatggggttggaggcagggcacagagacagtccctaagcaaggtaaaccatacatcaggtcagaggtactaaacgctctggtgaagatacggcagaaaatgaactcccagagctcaaaggccacttggtggtgtgcacaggcctctgctccagcaggtgggctgtatgctcaccaagagccagtgggtttgttcccacgccgacttggctgatgtgtacttgttactgtaagtgggtaaatgaaataggagataggctgaggattcaggaacgtggaagagacttatctctctgaaaattaagttgtaagtggtgaagatgtgggcttctgctgtgtgtgagatgggagccacggagggttggagcacaggcagaatgggatggacttcagtttcaagagactccctgtgtctgccggtggagaagggactagaaccagaggggagaccactgcaatcaacaagatgagaaaggatgagggtgtgtatgtgtgtgtttgtgtgtgtatacacacacatataaacatatacatacatatgtgcatatacatatttttgtaaactttgtattaaagtataaaatccacacagaaaaaaaatgcccaaagaagcattaatatggctcaattaacttttgcaagtgaacacacctgtatcaacatgtttagctccccacaggcacccccttatgcccctttcccatcactgccctcttcccctgacaagggtaaccactgtcctgagtctaaccccatagatttgctttgcctgtttttgaactttacacaaatggaatcacaagtgtgtacttttgtgtccagcttccttcacccaacctcatggctgtgagttacccgtgctgctgggtatagtgacatggccagacatctggcttccttccagtgtggtgctgctgtgacattcctgcacgtgcctgacaaagaacatgtgtgtgcatttctttgggttagatacctgaggagctgaattactgagtgataaggaatgtgaatgattagctttaggagatactgccaagctgttttccaaaatagttgtactgattttcccatgcccaacagtgtaggaacattccagttgtcccacatcctctataactggtattttatgtctcattttggccattatggtatgtgtacagtaggagctcattaatatttaatttgtagttccctgatgagtaaataacctcaaccactgtatgtttattggcgatctggtgccttcttttgtgaaatgactgtcccttgtcactttttgttgaactgtctgtctttttcttaattacttatagcagaggttggcaattttttttctgaaaagggccaaatagtacacattttcagttttgtaggccatatggtctctgttacaaactattcaactctgcccttatggcatcaaagcagctaagactgtatacaaacaaatgggcatagcagtgttccaataaaactttattgacaaaaataggcacagggccaagtctggctacagaagggcctcttcatatattctggatgtgaatactctggccattatacaaactgtaaagaccttttcacagtctgtggcttgtcttttcactctccttacagtattttttaatgaaattcttaattacagtatagtctaatgaatttagttctcctttataactatactctttgtcctgtttaagatatttgcttactcctaaatcatgaagatattctcccatgctttcttgtagaagtgttattgttctaccgtttacatttaaatctataatccagctgaagttgatttttgtgtttggtatgagataagggtcaagaatcactttttcccccactggatatcaaactgaccaagcaccatttattgtactgcattggtgtttttgttgaaattcaaatgactgcttacatgtgggtctactcctaaactcactattcgattccattactctacgtgtctgttttcataccaataccacactgtcttaattactacgaccttacagcaggacttggaatccagtaataacggtcccctagcttgaccttcttcataattgtcttagctatttctatctctggattttcctgtaaattttacagtcagctgatcatttacacacacacacatacatacatacatacatacatacatacatacacacatacacacgtacacacgtacacaaaccccctcctagagtatttattggaattgcactgaggttctgggcaaagtttgatgacaggatggaaaggacttgctgatgtagttggtatggggataatgatagctcaaaatcaagaagattctggcttcggctcctgggcaaatttcttctcctgcctccagactcaagcagatatcagctcttcctgagcctgccaatcctaggatcagaacgacactattggcttgtcttcagcttgcagacgacagatcttgggacttgtcagcctccataatcacgagtcaactgcttattataaatctctttacacacacacacacacacacacacaccctattgggtctatctggagaatcttgacttaatacaaattttggtaccatttactggtaatgaggaagatccaaggggcagaagttaagacaaaaaacaagagcccctttagacacaatttaagtgtgggctatgtgtgagacacccaaataaagatatatgtatttgtatttcttccacttgaccacgcaccaggccttattctaaccacattacatgtgtacctttacatgttttactctataaaaacaaccccatgaaatgaggactacttttatccccatataacaggtaggaaaagacaggcgcaaacagctgacataatttgctcaaggtagcacagatagtaagcagagcctctgtgttctttttttcttttcttttttttttttttgagacagagtctcgctctgtcccccaggctggagtgcagcggtgccacctcagctcactgcaacctccgcctcctgggttcaagtgattctcctgcctcagcctcccgagtagctgggattacaagcgtgtgccaccacacctggctaatttttttatatttttagtagagatgggggggtttcactgtgttagccaggatggcctcgatcttctgacctcatgatccaccctcctcggtctcccaaagtgctgggattacaggcgtgagctactgcgcccggccctctgtgttcttaatggcgacacactactgctgcctctaagatgctaagcaggtagttgagatgcatgagactttgctcttctgggtcctggtttccccttctggaggatgggaggtgggtttttaaaacactccctcccgttttccacttctgacacccaaggagcctctgcttttgaattcgcccagaagcactgtgagtcagagacctcccctgacccatatcctggatgggtggtgccctgcatgacccaggcaaggacaaacacagtcagcagtcaccaagtcactccaggcattgcctgcacccacatcagactcaggtggggagatccacccaccattgcccaatctcctgggcctctcagagctcagccctctggctctccatccagaggcaggaatgctggccgcctgccagcttctctcaagagacacatgcgccctttccctgcagccagcccagctcacttgtggaagtgaggtggggaatggccttgaaagagctcagggtgcccacaaggaaggccccagggagcccacttggaatccagtatcagaatcagctgctgtccctgcacaggtgagacggccccagaggaggcagagcctgcacccggaagccaaaggttgagtaaactcatctaaaagttgggagcaggtcacagaggcctaaagggacgttctgttttccaaaccccagtgttctgggaaaagtgcctgctccagactgcttggggcagagcggcggggcagggctcagggtggacattggcagcagccctgaaactacccaagaaggactctgaggacagccccagagagaccagaaaggaggcagggaaagagaagaagggggcgttcatgaggggacagcaggacgtgagatagacagacctcaaggagtgggcgagaatgaaggagcaaatgagaaagagccatgctgagccagccactgggagatagcggaagcaggaggtccaggccctcacaggaagggtcaagcccagaacaggggggaaagggcaatggggaagggcctgtggtttcagagcctcctgtgcaccaggtgctgtacctgtgcgaccacaccagagccaagttaacaacaatggtgctggcagctactgtgctgtgcactcactatgtcccaggcacactcacatatctgatcttccgtggtcctaagaggtacatacgatcattcactctgttttacggatgaggaaactgaggcacagagaggcaaagtcacagagctacaaaagaggttaaacggggatccaatggcgggcctagctcttaaccaaacactactacaaggaggggctgatcgtctcactttacagaagagaaaacaaaggctcagggaggccctctagaggaggaggacagtgggaagcccacacacgggcatggagcatccattactcatccagtggtaaggtttctcaccacaccttaggaggccagcacagacagacaaggaaactgaggctcagagacggtcagtggcatggcctaggacacaaagcaagttacaggaaaatgctgaaagtagggcctaagacctggacctcaggcctcagctctagtctttgctagacagaggagttaagaagcctctggaacatcactattttgttcctaagacaaagtaacagcaaagagaatttgaaaagtgctgcaggggtcagctgagaccatcctatacctgctgaacatgaaaacttaaggtcaggaatctctctgtgccaatccacccacccacccatgcatccaaccatcagttcccaccagctactacagtcatccaacccccacatccatctcctaatttcccctctctccaatcattcacccatccattcactcagtagtccaactgtcccactttccctcccagagcccaaccacttcggcaactatcaaccaaccacttacccatccatcaacatgccaaccaattggccatccatctactaatctccaaacctccgtcaccaacccaccttcccaattatataaccacccagccttccatccatctatccattcactcaacacaccatacctgaaggccccaatctaccattcatctagacacatatctgccagtcttcatatccatttctctaactgcctgaatatccacacatgcccccagctttccatctattcctccatccagccatctcctaaacctccaagcattcaaacactcattcactcacacacacgtcaattccaacatccgtccacattccttccttccctccctgcctccttctaccatccattcacctcccaaacccccagccatctgcgcctcatcccgtgtgcccacacaacccgtcaccacacttcccatcacacatgcacctgcctccatctacctactcagccaaccatctacttactcctagactctacagagcgcaagaagcaccagtgaaagacacaaagaaggtgaagaaactatcctgaccctccaaaaactgaatagtgaaagagcttcgctcctcttgaaccctcaacttttagagcttagaattacaggatgtgggtgtcacaaagaacctctcagtttccacagtcatctagacctgtgctatccaatatggtagccacgagccacaggtagctactgggcactccaaacgtacccacgacaaatttaggtgttttgtgagtataacatacacaccagattttgagaacttagtgttaaaaaacaacacaaaatatctctttaataatttttttaaataataattacatgtataattataattgaataaaatattctcatatttggggatctattaggttaactaaaatatattatttaaattcattttacctgtttctttttacttttttaaatgtggctactagaacatttaacataacacgtggcttgcattgtattcctactagacagcactgatgtagaacaaacccctcaactcacaggaaagggaggcccagagagggaagtgacaagcccaaggcatcacctggagaaggcagcaggccagaccccatcccagcctcctggccactcacctggatttccgcttgcagtagacgagaaggttgtcgaagaggaagaaggccctttcctggatgttgcccgcagagatctttaacaaagtcccttgcaggaggagctgagtgcagatgtctgtgaggttggaaccctggaagcgcaatgaggacacagtgaatgagccaacccaggaacatccccttcctttcccagagacagaacctactaccacctcctgccacatgccaaaaactccaccagcaagtctgtcaatggacagaaaatcaacacaacgtgattagtggcttctatctgctgagcatgccatgaaaatcctggggagggcacactgatatgaccgcatgtcccttttacaggagagggacttggggctcagggaggagtgactcacccagctcatacaggtaatagtaggtcctagtcaacatctgggtatattttggttcagtttttggtttttgggtttattttttttaaacggaatttcactcgttgcccaggctggagtgcaatggcgcgatctcggctccctgcaacctccgccgcttgggttcaagggattcttcctgcctcagcctcccgagtagctgggattacaggcatgcgccaccatgcccagctaattttgtatttttttagaagagacagggtttcaccacgttggtcaggctggtcttgaactcctgacctcaggtgatccaaccgcctcagcttcccaaagtgtagggattacagacatgagccaccacgcctggcctcgttcagtttttattgtgggtttttttttcacctattccttccccactacttatttatgtcttgacttgttactatatctcccccacctaaatgcccctttggtaaggacagggcccgaatcaactatgtgccctacgtatgcccagcacccacaacactctctggcacacagtaggtgctcaacaaatgcaatgtgcaaaccatcgggggcaggatcctgtgggcatttcatctagctaagctaaagatttacacgtcaatcccaaacctggtcacctatgttgagcagcaggggaaggggtgacaaagacgtgcatgaagttcactgaatgtcagtgaggttccgggcagcgtggctgggaaaggcatcagggaggagtgagcagaccttggaagacaaaaattaagataaagaggctggccgggcgcagtggttcatgcctgtaatcctttgggaggttgaggcaggaggattacctgaggtcagaagttcaagaccagcctggcaacatggtgaaaccccatctctacaaaaatacaaaaattagccaggcatgatggcagatgcctgtaatcccagctactcgggaggctgaggcagagaatcgcttgaacccgggaggcaaaggttgcagtgagctgagataacgccactgaactccagcctgggcgactgagcaggactctgtctaaaaaaaaaaaaaaaaaagataaagaggctgagggcagggatgggaaggtcctagctgggagggatccttagagcctgggatcacacaggtctccctgaaaccaagaggacccaggcaagggcagagagatcccaaagtccaaagagagaagaaaagagaccttggtgggcacagaatgccaaatgaggcagcccctccgctgaccctcaatccacgtccctcttctgtgattttggggaatggagtcttccctggtacttggctgcccagccacagactacatctcccagccccccttgtgccaggtgtggtcacatgactaagtcatcaccaatgtgcctccctgccagggcacatcctcgaaagaaaatggctttcctccctttcctctttccagaggctggggtggtgggatacactgcagcgggtggtgggatacactgcagcagatggtggggcaaggagctggagggaacctgggtcctggcagagcaaagctgcccaccccagtctgactgtccgcctctgcactgctaatgagaacagcgttgcaacgctaatgagccacctccctgaggccgctgcatcgcttccttacagcagtcaaccacagactttaattaatacaataaggtacagacaacagggtgccacggacatttaggcccaaggaatattatgcaaaagcagtgttttaagggagtttcacgtgacagaccagcagattacactgaacaaagaaacaagaagtgatgttgtccctgcctggaaatgaacttggggaggagagagggagaattattcacaaaatctccttccccaaacagtcaacacccagaaccaacatggagctcctaccccactgggacctgctgactgaattctttctgagacccagtaaggagaactggttccggcagctgagaagccaggctgtctgctaacggcctacaaggggctctctcgctgctgttagggctggtctgctctgtgtccgtggtccagttgggtacaacaaacccattcactcaacagtgccagagacccctctggagactggggaagcagcttccttgtggtcgagagctgtgcagccgggacaggagcctgcattcgttatcacacatcacggccttcggcttggctgggggccaggtgggcatggatgctggcatgcccacaggcagatctcagctttccagtgaggtagcagcctgccgcaccaagactcagggctgtcatgaggaagagcccctgggacccccagcatcctcgcgaactccctggggcttcatcatggcccatgcgcagcacacggcagacaaccggttcagcagtccctggagcccacgtgcctccccttccttttgccttggctcccttatgcccacccaccagctcttccaggctccaaaggggaagttgaagaagaatctggtacctggcccagctgccaagccccaagatcacacagccctagaaccctgctgccaagtccgtctcgggggacctaggagaggaagtccgccagcctgggaagctgcctctccagccttggccaagcaccacctggcaaactgcagctgaaatgccgagcacactacagggggataccccctccaccccagccctgctgagaagcccagccgcactcttgatctccctgaaatccttgaatctaggtcaagggtggtgctaggggttggatgcacagggaagaggctgagcaccaagacatgtggaccagtcaggactagagacctccttccttccagacatgcacactcagccacgctggagatgacaaaaccttacacactcaaagccaatacatgcgtaggggcggccacatgccacgcactgttctaaatatcttgtacaaactcagctaatcctcaggacaattctcattttacagatgaggagaccgaggcacagcgtggtgaagtgacttgttcatggtcacataggtggtaaggcagtgaggtggaacttgaacccagacaagcagcctccactcccccgacctgctcacctctaactcaggccgctcttcgaagacaacctgaagatttttctttgcaatcgatagtctagagcaggagtctccaaggggagagaccatgtcccactgggagcccaaagcactccagggagggtaggaaaaaaatatgagagcttttgtattgattttgtttcctcactcctgtttccttctctccccttgtgggtgagggcgagtgagcagttgatcatctcttaaaccagggctgccagagccagagccagagccagaaaatggagtgccttccttccttcctttccttccttcctttccttccttccttcctccctccctctctttttttttgatggagtctagctctgtcgaccaggctggagtgcagtggtgtgatctcagctcactgcaaccacctcccaggttcaagcgattctcctgccgcagtctcccgagtaactgggattacaggcatgctccaccacacctggctaatttttgtatgtttaatagagaaggggtttcaccgtgttggccaggctggtctcaaactcctggcctcaggtgatccacctgcctcggcctcccacagtgctaggattacaggtgtgagccaccgcgccaggcttgtttctttcttcttaagagtacacatttccttttttatcactgtgagcttcacatggaagtccatgcggctgcatctggagtgtgcctctgaggaggcgcagcccacgctgggcacaagttccagtcaaagctcttggatactttttccatctaaaaaaataaataaataaagagatcccactttgctgccagggctcctcctgacatgtattgggcgttttctctgagccaggcactgccgaggactctgtaagcatcaactcccccgtcctcaagtgacccatgacgggggtactcccatgatcctgacttcgcagatgaggaaactgaggcaaaggaatctctccccacggagggggttgtctcattcactcacttgcaaggtattgtgacacactgccatttccttgtgctcagcaaaatggattcgtggattcacttatctggttttatctaaaccagtctcacgacaaacagtggctcacaaaggatcagggggtaaaaaacacacatatgggagatcaaattcatgaatgatgcaacctcaagcacacagcaagaaagtggccaaaacaagactcctcttgctccaaaaacaagccccttgtcagacatctttcaagagagagatgacagctatctgatcagatcagcaagaggtcacacagaaagatgggaaaggatcaaaagaatatgtcaaataaagatgtgcaatcgcatcattaacatgaactaccccctaaggcatgctgtcctcagagactgtaactactaacagatagcatggaagcaactccactattagacgtcattttttctagctagaacgtattattttcacaagtcaccttgaggaacaaactgcattttaaaaacctttctacttcatagaaaacaatttcacgtttttcaaaggacattcatattccacacctcactttatcttccaaatgaaaccaaaaaaataacttcagagatattatcactaaaattaaacaaataggagaaaataaggcacaccaggcaggacaaacttactcgaggcagggcaaacttactcgagacagggcagtctataagttacagggctgggcctcaaaaccaagtccctgtgcctcagctgcctcatctgtaaaatggggataatagcacctcccttgtagggttggaagcttgtaacaggtactaaataactgccaacaattcttattttaaggcactttatttcctattgcatccagcaacactggccactgagggccactgagttctcaaactgtacatgtttagggtcataaagggttttagagacccttggtttccatttgcctaggcccttaccagaaaaaaggcatctggaaatcacttctgctgcagctgctgaggagcttgctcaataccctctcctttggggcccatgtgagaaatttcttttccaactgagtgccaggaaactctctgtctcccagaagaactgctctgcttcttccttttctgacaatattaggtaacttatgtatgttgctcttttcaccttggcttccaggaaactcaaaacccatatagacagatgtttaaattagtcacctctatttgctcttgaagttcaaagtggccatgtgacccatttctggccaatgcaatgaaaggggacacctgtatggggcttctagaaaaggttttcctccaccagggaagagatctccccactaactaccctggccatgcccctgtctcctccggttttgaacacatggtgcctggagctgccgccttcatggaagcatgagagaaagaagaggctcaccagagaccaaatcagagctctgacatcacaaggctgagatgagagtcttcgaggatgcatcctaactgacgcacctgaggatcaggcaactttcagatgcaggaaacagaaaccaagccacgtacttttaagcaaaaaggaatgaggggctttacttattcactgaaggggctagaggagccaggaatccaggccgagggccccaggaaaccagccacaatgcagaactcacccaccaggggagccactgcccctgccccaggtgggaaaggagaatcagaacatcacctgtccaagctcaggctccaggaaaaggctcctcaggtggcatcaaggattcagtagttgttgcctcaactgttaactgcaaagccatcccatggctgctaccccaccaacaataaaaaaggaaagcctaggccatgcatctgacgcacaggaagctggcgcccgggccctcttctaacgttaccacggaaagccaaacacaaccatggctgtgctttgctgcaaaaatagcacaaggggtggcctccaccccacttccaccttccaaatctcaagcagctggatctgatcttggccagaccccaaatcatatcccaaactgaagccgggaaatagagctcttcactctccagcctcggctgggcaggaaggcccagcagaaagagcgcaggggacatggcaagtggattgaccaatccacaatatccacccctccctgaatgcagcccctctcctctctgcagccaaacccgtaacctcacagcaatacagcctcacatttaggattccccagcacggagaaaagaactagaaatctcaaatatggcaagtgactccaaaggccagaaaatccaaagggcctacggcatatgattcacgtaacaatctctgcccaagagactttcatcttccctcttaatctcctgttccagctgtatttactctgatatggatttttttcatttattcatattttcccatttccttctacggattcacaggaaacctctaataatctaaggaaggcaagggggcttaaatccaatgatctcaagaaccccatcccctaataatcatgatagtaatactaacagctaccatttattgagtacctactatgtaccaggtacagatgaggatactgaagttcagagaagtgatgacatttgcctaaagtcacccagcaaaggagtgtcaaagccagaattctgtcctggagtggacactagaacccgacccttgacgttggcatcaacagctcaaaggcctccacataccaggcaatgcatgaaagagaaggggtggggagataacagggggtggtggggactgaaggaaactagaggctccagtgactatttccatgagatataggggcccagtgtcaccaagtttttaagagaaacttgaaatgcaaatttgtatttggatttaattgaaaaataattaagcaatcttttgcaaacactgtaggccaaacaaaatacattgcagactgacaggtgcccaggcctcagttcatgactgcacctgtgcacctcctggccccctgcggcccaggaagccccctcctgtcctgtacacacctcccagccttcgatgtgggactgcagctgctccagggcttccagcttctccatctgccgcttggtctcattgatgttggagcaaacggtcttcatggcctgcagggcactctggaccgcggggtggtctgggtgcttgccgggagtcctcttggccagctcctggggtagaatagaggtggggagaagaaagcaagacatcaatcaatccagaggagacccaggccagagctgaacccaagaaaacagacaaaaactcctcgcctggtggacattacattctagtaaaggagatgagccaaagcaaagaaaactcaggtatggaatccaatgtcaagcagtggtaaacactagaaagacaaatcagaatgagggagagggaagcattgtttcacaaggaggtcaggggaggcctctctctggaggtgatgtttgagcagaggccctggacagagcaagagagagagccctgcaaaaacccgaggggagagcctgccgggcagggggcaccgtggtgcgaagggtctgaggcgggcacatgtctggtatgtaatgaggaacagaaaggaggcagtgtgtctggggtggaataaacgagagagagaaaaacagagagatccgcggtcacagaggcggccccaacactgctcctccccaggcccggttttcttatcataagatgggcataaaaaataccccaccttcacaaggatatgggactgagcaaatgaagtggctcttaatccatgagaagccccctgcccccaccgtttcccactgccagctcacccctcaactcagacgcaggctgggacattgcaaaggccaggccagtcttaatcgaacattccagccagtaaatgtgatgggagaggaactgaggaggaagggatcagctgggacttgagatatcaaggaagatttttcaggccaaattacccaaatcacccaaccgcccccgtcagtctttcatcccgaactgtgctggcagagataattttctttaatcatctgacccagaaacacgcccaatagctccagtctctcccctatgccctagctctctgctccctcgacgatccagataacatccccgcagatgtgacactcttgcatcgtagttacgagcacaaatgtaggttcaagggctgactctgcccctcactgtctgggtgaccttgggccagtcccctctctatcccgggcctcggcttcatcatctgcaaacctgtgatgatgaggatgatggtgatgacgatgacagcaattaatgtctactgagccttcgccccacggttttaaggtggcttctgttattagaccatttaacagatgggcggactgaggcacagcaagaaagcctaaggcctcgaagaagtacaaggaggaactgggatttgaacccaggctgcctggtgctgctcatggttgtggtaagcaataaatgaggtactgtaggaaaagcaccaagtacatatatagtaagcactcaatatatgcgagccattagcattctccttgctgtatgacaacacgctagctgtaactgtgagcagcaatttgccacaaaagggtattgttctgagcactccctggagtaaaccaacttcaaacacatcccttcttcattcacttattttcttccctgtccgaaaacaaacatcctattttctgaagaccaggtcctaagattcccaaggcccagctggtctgcatcatcaggcccctgggactttgctgagctcttgccacgcacccaggcaatgtgcccaaaggatgcaaaagaagggagatggagccctgctcttcctctggaggccccagcaatgaggctggaaaggcacttccctgggggcttgagaaaggcccagagagcagcaccatatcctgaaaatgctggtgatcaatcaaaagagaagcaagcccagaaggcttcaggaggaagcaacacaaaggcaggcagggcacccagggccagctctgctaatgcggagtgtatttcgactcattcttcactcagcaaatactggctgagcaactggtgtgagcctgagctgtggaggctgggcaaagaacaagatggtcctctgggagctcatggtcaagagtagaccggtcaacaaggtaatgactattactactaccaacagtaacaacagctaatactcagcaagccctcaagctcctgtcaagctcatttgatcctcatgtcaactctctatcaggtaggcaccattattcttctcgattggcagatgcaagacctgaggcacagagaggtcagaccgtttgtccaaggtcacacagcacatctgagcccacccagtctgactccagagtttgtgctctaaatccccgtgctatttacgacttttcagacagttaagtacaaatactttcctctcaaataaatatataatttatagaattaaagggacaatgagtgagggaagtgccgtggtctgagaaggtctctctggaaagacaggcttgcgagcgaagcttgaatgaggtgaggccacgggccacactgcgtctgcaggaacagcactccaggaaggagaagagcacgtgcaaaggccctgaggcagcgagaagcagcagggaggccagcggagctgcagcagagcaagtgagcgagagggatggaccacagattcagacaagcatgccaaggccagatcacatgaggccgcagtggggtgtttgggtttcctcccaagagccatggggaggtgatgggggtatgagcagaggcctgacaccaccttctcaccctttaaaggacctccctggctgctgacaggaggatgcacgggatggaatgtgcagtgaatataaagtgggaagaccagttatggctactgccaaagtccaggcaagagcagagggtggcacagaagctctgtgcctcattcactccatgcatgcatgtatccactcagccaggctccagtgtacctggccccatgttgggctctctgttgtacacagatgacggcagacactcccctaagccatcagcctgcttgtaggcatgtccacaaagttacaatataagaccgtgatcttatgaccatattcagtaattccattcgatcctgcaaagctaccccagtcccaggttccctgaagtggtttttggcatctggacctttgtgaggccagccgaggccagggagtgaatgtggccagtcagctcccggtgggcagggacagaggctgccagttagtgagacccccgccccaggttctacccatcatccctttcatccaaagcaggggtcaaatgacagtccaaggactgagtccaacccatcacccgtttttgtaaaaaaaagttttgtcggaaccaagtatcctcatttcactgatatattgtcagtggttgcttttacactacaatgacagattgtatggaccccaaggcctaaactatttactatctgatcctttaatggaaaagtttgctggccctttgttaaaagcaacagaactgattcttagctgagcatgagggcacctggaataaaggccacacgcccagtctgcctggacacaaggttctcatggatggggcgcgagcagaagtgccgggtgcagtttcccttctcctttccctcttccttggctggaatgtgggcatggtgcgagcacctgaaaccctggtggtgaggggcacacctcagggttggcagaacttggtgctgtcagcatggagccaccatgctgccctggactgccttgacagaaataagcttagacgttgtttaagccactcttgtttcagagctatgtcactgcagctaaaacatatcctattacaaaagaccccaccgtgttgtggcacttgggataaattcaccatgaaactgtgttcttccttctgctggctctgttaagcttggccatcagtgaaattactttgcctcccaatggccctagcaggcaggtgcttttactatccccacttgacagatgagaaagttgaggctcacacagaggcaaggtcccctacccaagggcacggacagctaagcggctacacggtccagctccagagctcacatttctgaatcactattctgtgattctccagcctgaggccctgggcctcttcccacctcccccaacaaataggaagctctcaccacttttattcttgaagctaaaacctgatgggtccatggcacccctctgatgggcactgccaccatatctgctcctcccaaaccctggaagttggaatctcagtgaccctcctccagtggttccctgtggggctgccaacacccagtagttagtaaaagtgaaaaaaaggctgcttcccttttctatctgtccgcctctatctctattcttgctctaggtcagtggtaggggtagggaattgaaaccaagcaagacctggccaggcccatagctggaccaaaaccgcaggggaagtgttagctttggtgtcttggttcacggggcatgttggctccactctgtggagctccaaaaaatgagggcccattcctgcctccaggcctttggacttgctgtttcctctcccggcacactcctcaagatctcaagaagtaacggccacagtggctcacgcctgtaatctcaacactttgggaggcccaggcaggcagatcacgaggtcaggagttcgagaccagcctggccagcatggtgaaaccccgtctctattaaaaatacaaaaattagccgggcgtggcggcacgtgcctgtagtcccagctacttgggaggctgagggaggagaatcagttgaacctgggaggcggaggttgcagtgagccaaaggttgcggtgagccaagattgcgccactgcactccagcctgggtgacagagcaagactccatcttaaaaaaaagaaaaaagaagaaataacacaagccaggcatggtggctcacgcctgtgatcccagcactttgggaagccaaggcgggcggatcacctgaggtaaggacttcaagaccagcctagccaacatggcaaaaccccatctctactaaaaatataaaaattagccaggcatggtggtgcacacctgtaatctcagctacttgggaggctgaggcaggagaatcgcttgaacccgggaggcagaggttgcagtgagccaagattaagcccctgcactccagcctgggcaacagagtgagactccatcataaaaaaagaggcaacatagtactgtataaagataggcctagagatcaatggaaaagaattgtaggcggtggccagcagttcaagaccagcctgggcaacacagaaggacaccatctttaccaaaaaattttaaaaacttagccagacacagtgatgtgcacctgtagttccagcttttggaaggctgaggtgggaggatcacttgggcccaggagctccaggttacagtgagttataatcgggccactgcactccagcctgagtgacagaacgaacctgtctctattatctcttttaaaaaaaaaaaagagagagagagataggttgataggtgcagcaaaccaccatggcacatgtagacatatgtaacaaagctgcacattctgcacatgtatcccagaactataaaaaaaaaaaaaaaaaaagaaaatcaaaagtaaaaatcaatgcatatcaaaaaaaattgagagtccagaaataaatccttacatttatggtcagttaattttccacaaggatgccaaggcaattaaatggacaaaagaactgtcttttcaacaaatgatgcaactgaatatccatgtgcaacaaaatgaggctggccccttcctcatgccacacacaaaaatggactcaaaatggatcacagacctaaatgtaagaactaaaactataaaactgtcagagaaaacacaggagtaaaccccttgtgaccttaagttaggcgaagtgctcttagatatgaccaaatgcacaagcaacttaaaaaaaatagataacgtgaatttcaccacaatttaaaacttctgtgcttcaaatgacactaccccaacgtgaaagccaaaaaataaataaaatttaaaaggaagggaaaagacaatctgcctaatgaggaaaatagtatcaattacacatctgatgaggaacttgtacccagaatatgtaaagaacccttacaacttaacaacaaaaagataaataatacaagtaaaaaacaggcataggacttgaacagacatttctccaaagaagatacacaaatgtccaataagcagatgaaaagatgttcaacatcatgtgggaaaatgcaaaacaaaaccaaaatgagataccacttcacatctactggaatagctataatccaaaacatgaataacaactgttggtggagatatgaaaaaaatagagccctcctacattgctggtaaaaatataaaatgctgcagcagcttaggaaagcagttgggcaattcccttgagacaccatgatccagccatacctgaagccatctatccatggcttgtcagttatgtgagcctatttattttttacatatatatgttgtgtaagtcagcttgggctagtttttccatctcttatttgaaaaagttcctactgcttcacagtctcagagggagtgcacagatatggaaactcgaaggtgtcccagctggtctcagacaggcataaaatgtgggtatcttcaaagccaacgagagcttgagcgatactaacaaaggtctaacatgcgaaaggagggaggtgagaaggctcctgcccaattcagaactgaacagactgtactaataaatcagaatagagtcacattcaaaggagacatactatggtactgaaaaccctggaatccatatccaaagtggaacagatacatgaacttccagggtttggcccagagaagagtatttctggaaggaacccaagaggtgcttgcttgcttgcttgctaagcgtcttgggagaactacatgactaagaggcccggtgaatctgtaagacctcaaggagtccaatgggaccagtgcaagagaccactgtttgaatgaattaatccattcttacaccacttggagctttctcgcaagagagagggctaccttgtaaggtagtaagttccccatcaatagaagtatcaatgatagattcaggcccactaatgccttattctagctcaaacccattatcagatgatgaaactggagagctctgtggtcaagagaatgggtgctgggaaaagggaggcatggtctctacttcgcctccaccacatctcagctgtggggccttgcacaagtggcctcacctctctaaagccaagtgtgtgcatctgtgaaggaggctaagactcaccccctaaggctaatgtaaggatccaatggggtgatgaatgtaaaagtcttggtacccaataaggacacaatatttatcatcatcgtcattatgtctgtggtaatagtggctatttcttatgatttctgcatagtaggaataatagtgaaaatagaagtcgtggtaatagtcctaatagctagcatctactaagtacttactgtgcaccaagcactgctcgaaatttaagtgtattaagtcatttcatcctcgaatcatcccagtgaggtgggtactattatcatcccactctatatataaggaaactgaggcacagagaggttaaaaccctcttgcccaaggccacagagacagaaagtgggacttggcagatgccaaccacatctacaggcccctctagaaatagtaatagctggaaatgaacacctccaaatcagactcttagaacacaaagtgtctaagtagggcaggtcctggggatcctttagaaaaactgagtgcagggaagagaggggtgtgccagggctaccctgtgaaccagcagcattagcccctccaggagccaggctgatggccttccccagcatccgcccctcgagtcctgtgtggtttcgcgagtggggccccaagcgaaggcttcctagaagagaggatgttggcgcagagaagcctgggcttccgcgagatgcctcacctccctctcgcccctgcaatcacatttactcaaaggatgtccaaaggtgcccgctctgagcagccccttcatgtccccaaaactgtgtcatcagctcccagcatggccgtaagaggcagcctgaggcgcagggcctcaaacccaagggcaacaaacaaacgtggctagagccagctcctactggctcactcagcttcaccgaaggcccagctcactcagccttatcccaaggcccaggagaggactgggggaagaacaaagggctcagaggaagaggaggtggtaaggagagaggaggatgagctgcagaggtctactgcttccacctgctcctctctcgggccatggagtccaggagaggtcaccccagccagctcccagtgtggatctgtgactaaagcctgaccttccatcctcccagccacacagggagagtgtgggacccatgctgagccggtgggcctcaggctgggacttcctacgcaaacgctgggaaaggcatgctctcctctccctgggtgggtacactggtcacacacaggcctgaggctgctggtgaccaacgacgccactgtaagaaagcagcctcctgagcacaaggctggcactgagggaaacacagcaggacatggacagacggagtcaggatagtatcgcctgagccctggatgcagctatgcctgaagtcagacctacccttggtcttttctgttttctattctttttttaaaagtaagtttaattaacaatgtcataaaaacaataaagtagattttcagtcactggcaagcgaaatcataagaaaatgaacccataaacccacagtgtgaaaacaaagctgcaattgtcactggaagatgtgataatacccaccattctctgtgacttggggttggtgggggttggaaagccatattgtcctctccacaaagagaaaaaggcaggagggtggtgtcaccaacagggtctgggtcaagcagaacaacaccaactttctggggacacctcagccaactccaggaaggggctgatcctgcactcagtgacttgcctccagtcacacaggcctgcccaaggctctgccatctaagctcaggaagcctggcttgctcctgtacccacagtgctgaagtcccctgcggccatacctagggtgacagcagaatgcaaatgaagaggtgctaaggatacccaccaccactttaaaaaaaaaaaaaaaggaaaagaaaacaagaagcgaaaaacatctggaagtccaagagaacccagaagtgaagagctccccagcattgcaaaaaaaaacccacaaacaccctgcatgcatgcaaatcatatgcagacttcatgcaaatgtatttccaattttaacaatttcagcctctgctgcatgtctaggaaaactgtagtcccaccaattaggaattagcaggagaaaggaaataatgctcgtgggttttaaaaactcctttcttctactcagagaggaaaggggggtaaagtgggaagagggttcctatcaggaagttcctgttctggctttgatgaggatgtgctgtgtgaccttggacaagttgcctcccctttctgtgcctatgcctcttgggtatgcaaggtagtgatgagaccaagctaaatgttatcgccagcctctgtcagcaaagcagaagctctggccaccctggacttgcgtttccaccttacagtaacagttggctgggctgagcagtggctgttccttagaagggatgtgtgtcctctagtctgccacagttcccacccaactcgctaagttacaaccaccctactcactcgtttcctgcacgtgccctgcaggtatctgtgtttgtgaccctagggtggtaggtctctactgaccctccaggctctgacattcaggagctctatatccagcctttcaaagaggccctagcacggctcaccgtgaagttctacacctcttgctcccacttccaggctctgcacaggcatttctctagagaaaagggtaaaatggtgagagatggtggtgattgatggtgatggtaatggtggtggtagtggtgatgatagctataaatttcaacttagtggaagcaaaaataaataaaaataaaataaataaaggaaaaagagcaactaagccaaagaaactaaaacaatccaaaataaaacacggaaagacgcaaaagcatcaaaaaaagaggataaacagaaatcaaaaagaaggacggcagaaccaagttcaaatatattaataaacacaataaatataagtggacgaaacgctcctgttagaagatattatcagatcagattttaaattgaactctatggagttaacaaaaaaagcacctaaagtctaaggattcagataggtcaaccacaaaaggagaaataagatatttcaggaaaacactagtcaaaagaaacttaatgtagttatattaatattggaaaaaacagacgttgaaacaataaaaataactaatattaagcacatctcagcattttacagatatttttcatttcatctttataataaccaataactagggcactatttcacaggagaaaactgaggcacacagagtttaagtcagatttcaaagaggcaatgctaataaggtcaggagctaggattaataagcataaaaaccattacaatatttgagtcaccaacatttaacaagcatgaccatttactcagtagtatgcaaaatgctttcatgagttttttcatgcattgtctcatctgatcttcacagcaagcctgggaggtaactaccatgcccattttacagatgggaaaatggagacaaagagaggttcagcaacttgcccttggtcacacagctaagaagtggagttggacttccgaattcactcttaaccacacacagtacaagagaaagtagaatccaggttggaccccacaaaaggtgatctaggaaggctccttcgaagatggggcagctgagcatggctttgaaaggaagaggtgatggcaggaccccccccccaactccccaacaaggggtgtcccgaggttagtgctcaccacacaggaaagagcctaagcacaggctgacacaggttgagtctctggggcagctgtgggcgaggtgttggtgctcggcccgagagacaggatgaaggggtgggcactgtggttgggggaggatggggtcagggtagagggggctgcagtgaagagatctctgacttcctgtgctttctcagcaagacggtgacaatgcccgatccccagcagatgaggagctcactgcataacatcagtcagacaaaaactccaaagagataacccaaagtatccagaataatagaaggactctgggaaatcaaaaggacaattgtccaatagaaaatgggcaaaggatgtgaaaaggcaactctcatgaaatgcacccacctccactgccaccaccaggtcaagacatctcctacccgaaccactgaagccaagcactttctggtctccctgactccatcctgaccaccccacggtccatcctccacacacagccagagggaccccattagaactaaggcagatcccattcctccctgctcagaaccttcccatggctcccacctcaccaagatggaaaataaagaccccacgatggcccacaaggccatacctgacctggctccattacctctctaaccttactccctcgctctctccctatcctcttcctttccagtcaccctggcctcctcactgttccccagacacaccagcaacagtcctgccccagggcctttgcactggctgttccctctggaacaattttccccaaggtacctgcttgacttcctccttcacctctttcaggtctttgctcaaatgtttccttctcagtccagccttccctgaccacattatctaaacctgcaaccccctgagtgactcctggtccttactgatcttctgaacctgatatttattttttccacagcatccaaatattccatctaaacaagcatacacatttcttactcatttgtcaccatctcccccaagaagaatgtccgttccaaggggacaggggttcaagctggttttgttcactttgtacctctagcacctcaagcagtgcctgacacataacagttgctcaataaataggtggtgaatgaatgaatggcttcaaaaaccctaaacactgcagcaccaaccgtggctgtctctcagaggacactaggaagacggaaagggatttgctaagagagtagtattctactgtgtgagtcactgttttttaatgttggcttctccccttccccctccacccatcctacataaagtctgctctggtgccacctaaaatcttctggaaagctatgagtagtatacgtccatgctccgggaaacacgtcactcccagttgtcccccttcaccgagaattgaggtcaacacctccctggcaatggacctcactcagtccatcccaggagcgcggacctcagtatcagccactttcctcccagccaagtagacagaggtaacagccgaatgacaaggtccttgcgctgcacttgggtgacagctgcatcacccacagacagacatgggaggtgcaggagacaccagcggccgtgcacagacccaaggctgtaccccaagcagccactctgcaaaaaacctccctggatgcaaccccactagagcagctgttccgaatggacaggtcccaggatgtgtcctgttggggcccacagtgtttaacaagttctgaatcaagctgatacttggacataagtaactttcacataaaagtcccaatttctggattcagaaacagttggcaagaagacaggggtggcctttccacattcattcaataagtgaccaggggtatctaccctgtgcaggcaccattccaggcactgaggaaacaggcccatatccctgcccttggggagctgatgtctcaaaatcaatcaggacaccaagcgtcccaggacagaatgtgagccagcgagcagtgctatgaagaaaaataaaagcaaggtgaaggggacagagaatggcagaggcagctcctctatcgcagaggtggccagggaaggccttgggcaggaggcactggagcagcagaagcctgacaaagatgaagagtgagcctcaggagacatggggtaaaatgtcccagcagaagaaagagcaggtgcaaaggccctgaggcagaaacctgcttgttgtgttcagaacttcaggaagcaagcctggctgagcagagaagatgacaaggtcagagaggaacatgggtgagatcggtaggacactgcagatggcaacagcaaagaacttggaccttactcggagtgagcagagagtcctgggagggtagtccggggaggagtgacatgaactgacttcagtttagctgctgagctgggagcagcctgcagaggacaagaacagaggcagggaggcccgctggggccgtggcagtgtcccagcatgggggaagtgaaggcattcggaaacagctggactctggacagagtctgagagcagagccgacaggacctcctcatggcgagacatgggggtggggaaagagggacaccaaatgtaatcccaaggtttggcctgagcaaccagaaggacagaggggctgtctgctgagctggggatggagggggtggtggggaggtggtctggggaaaggcatgagtatgcttggtaagagatgcctgccagacactcaaatgcagaaactcaacgggccggaagacaagcccagggtctaggggagaggtccgggctgaagtcatccaggtggaaacggagtttaaggccatgggaatgtccacacaaatcctgtacatggaccttcagagcaacatgactcacaatagccagaaagtggaaacgacccaaatgtccatcagctaatgagtgcataaacacaacgtggtccagccacacaacggaagatgattcagccacaaaaaggaaggaggcaccgacacgctccaatgtggctgaaccttgaggacatgagcctaagtgaagccagccaggcacgaaagaccagcactgtgtgattccacttggaggaaatatccagaataggtgaactgacagaggcagaaagtagacaagtggtcggcaggggctggaggaggggaggatggacagtaagtgtttataggtctggggtttcttttgggggtgacagaaatgttctaaaattattgtggtaatggttgcacaacccttgagtatgcttttttaaaaaaggccacagagtagataaggccaccacaggagcaagtctagatgggtaaacaaacggccagaggactaagcccagggcccatctctcctcagaggccccggagatgaggaagcagcaaaggagaccaagatcaagcggccagagagctgggggcaaaggtggcaactgccccctgagacagggtatgtcccctgcagtcagccccaggatgtcccctgccacacactccaagctcctgcagggcccagcccaagtctggaagctccaaggggcagggcccgggtctgtcttgttctcagctgtggacagtgagcagcgacacagatgtgtgcatcaccaggaaataactaagaagatcagtgacagtcaggccccccaccggcaccagccagctgtgcaccaggggcattaccccaaacctgaatcattcccctggcaacgtgaatggaaaagtcaacaaagcctgaaatgccaactgcctatcctgggcctcggctgaggagtcgagatagaatgttccagctattcttaggcaacgttcaagttcagcttttgggggctgttcccaaaaaggctttcattctcgcctcttccctcttcctacccaggctcctcaacattgtgtgcccaccccaagtgggagttcagctcaaacaagagggctcagagggccacggggacccctgcaagggcatctgaatctggagaagccagagggggtgggctggggggttgagctcagctgcttcaagttcatgggatcatctttgaaaatccactggaaaatgtgacagaaagaaggaactccggaggtgggggggacagaattcccctgagccccgggtgtttgctgatgcaaatgttcccgctctggggccaaaggccggacacactgaggagttctgtcaggcggggagcaaggcatggccccaacgggagtctaaggccctgcttgttctctcccaaacagcacccccaccccacaatctcctacttgataaacacagctagagaccaaggaaacaaggcgtgccccgacggagcgcaagtgggcagagtaaacagccgtctggccaggagagcaaaccgcagccaccccatcgcttttcctgcgggccatttcctccacgggtcgccgggcggttctgcccctgctctctctgttctcctgggaatccagagcccaggaatcccaccagaccaaactctggcccctggggagatgggaacaggcctcagaaatgcctgggcctcacatcgagcctagagtccaccgtacacacaggtccagcgacaccatgtgttaaaatatgtcacggaagctgcagctccaagtgcctgctggaacccagactttcgcaagatccagaaaccaaacctcagttcagctctgggccatggctgctggttcttcttatgggtcagatgttcaaggttttgaaacgcagagaagaaggacactggcctcaaaacacagagccaccgaccttagacgccatttagggaactgagaagggcagcatcgctgacactccagcactttggcagtttaactccccaaaatccttctcagcaggcagtagagccatatggttaggggtggtcctctggaatcagaatgcccgggttctaatcatgattctactgcttatctactacgtggccttggaaaggccacttcctttctctgtgcctcagctgccccatctccaagagggggctaatcacagtgcctaccttgctgagttgccgttagaactaagtccatgcttacttgtcataacaaccccgtaagtaccattaacatgaaccctatgtttcaatgagaaactgaggcacagggacggatagtgacttgcccaaggttacacactcgtaaatgacagagaaattcaaatccagactgcttatggctgcaacggctgactctcatccaggggtcagcacatttttgctgtaaagggccagatggtaaatattttaggctctgctggctacatccactctctgctacatattcttctggggttttgcttgttcgtttaacaaagcttttaaaaaaaagagtaaacatcattcttagctcataggctgtataaaaacaggccatgggctatatttggcccagaggccacagttttgcccaccctgtctctaaccactacagtacactgtctcttaatgctggtagctaatccaagttcgaaagacacatcacacagatcacacaaagcacatctgcaggcccgatttggtccacaggctaccagtttataagtttcacctgaagcttcttccacaaccaggtgaagacctgagctacagcatttctaagacctatctagggatcgaagccatggcaacaacaagtgctgaagttcctttcgagattgctgggagagatcaacagcaggagcagaccagaggaggcatgggagagctgcgtcccacccccacggctgcgcacagcaaagtcctgtgttcgtgggcagagctgatggccccagggtctggcccagttcagaggctccagcatcacccaccttctccagcagaaaaccaagatgaagaatgccctggtacccttcccctccccttttgcttccagttcatggagcaaaaatacacaaacccctgtgagcaggtgcgtgaatgaggccccaccagccaaattaatccccccacagggaacctaaaacacagctgccttcaggacagagccaggacaggctccggccaatagccattttgttcagccatttccaagggctgaaaccctgggctgagagcagtggaaggcggaagagccgtcccctgggctcaggatctgtccagcagccaggctgaagcctagaatcaagacttctccatccccacagaagcagcaaaccttccctgctttgcccagccaagacaaagccagggctggcggcagggaaggaaacagcaggtgtatggaaggctgcatttgcccagccaacacctatgcctgccctcaccctgccttccacaaacagctcagactttggtcacgtggggttcatctgtcctcactcatggcctgtgggacctagtgattggttcaaggttggagcacatgacccaagtctgagccaattagaattcccttgctcaaaatgattggttcaggagtgcagcacctgacccaggtctcagccaatcagaacacaacactgccctgctcactgtcattggatcagagtggagtgagaccatgtctcagctaatcagagcacagcaatagtgattggttcaggggtaaagcacgggtctaagctgactggaggatgataaatggtacatgcaaaggcttcatgtaatttgtccaggtcaaagcgcatgactcaggcccaaaccatttggcatatgaccttcccctggctgcagatagccaaagacagaatgaatctcaggactttcctcagctcttagtagagaggttcactctttcccactgaccttaaacttgagaggatgtgaggccaggagaaccacagccacctgctgccacactgaaaataagcctgaatggtggaaagcagggtgaacgagagagaaagaggcagggtcctggtttaaatccagcccggcccaaagctgacactgctgctagacttctcagatacttgaactaacaaattttatgttatgctgaagccaaagagttttctgtcacttcaaatacgggaaagtctcaccttaaggaggagcgggtacttgcagatcctctggatcggagacaacaggtagccttccaaagggatgtccgtggtcttccggcctcccagaagcatgcagctctgcaaagggacaggagaccttcatgaaacccaccaaggatagcacagggacatagccaccctcaaccatgagaaacgctctcagagcacagctacaatcacttggcaagcgatttagcgacccgtagaagtgaaaacgtgcatcatctacaaccaacacaaaccctactgggccaaatcttgcctactccccattttggtaagttttattagaaacacagccacatccatcacattggctgtggccccctacaagctacaacggcagagctgagttgttggggaaaaaaaggccatatagtggcaaaacttaaaatattgactatctggccttttacagaaaaattcacccattcctggtctagagaagctttcacatatacacaccaggagactcaaaaatgccttgcttacaacagtaaaaaatgggacgcgacctaaatatccatcacctgagaatggaaacatctgtatttttgtttcagtctgtttgcagcagatttatacaatggtagctagctatgcagcagttaaaatgagataaccagggccacacgtagcaacacgggcgaaccccaaaaatgtactcttgtgcaaaagaaagaaggatatgtacagtatgaagccacttacagagatcttttaaagacatggcacataaaactatgcgctgtttatggagagcatgtatgaggtcaaatataaagacatgcgtgttaaaggaatgcacccaattccagtgggggttccctctgtggagggagagttttgggttggaaagtgaaccaagaaccttcaactgttactgaaaatgtcctagttctttagctgggaggagtgtacgtgattctgtcatatgcatacctctattttggcttgcagagttaaaaagtacagctctcttaggaatggaataccgttaccctaactcccacgctcagccctaagctcctgtccacatgaatcaacccagtgttctccatgtcaatacttccgccctgcagcccccttgcctctctcggctcattccatgcctcttctctggaatgtattctcttccccaataaaaataataataataataatactgctatcatccatcgtaaacactgaccaagagctaatcatgtgtccagcaggcctctagggctcccaaccaccaaccaccctatcaactgaaaactatgattattctcatctcacagcttagatccctggggtgtgagaggtttagtcttttactccaagaccatcccagaaaagtgagtcacagagctgggacctagagccaggcgggttgacaccgagtctgggattgaaaccatgatgcccatgtgcccttaccccaagcccacccatgcaccaaggccatccctgccacccaacctgctctcaattcccaggacttcttcctcctagagccttcataggtggccatttgttccacgtggctctcaatcacattacaggcactaccctctccttcagagaggctccaacttaagaatccatttttgtttggcaggaaccatgagttctgctgtgtttccctgccatgcccttcacagtcctgggtccctcaggctcactatgtgcccattatgtgtaagtgaatgaactaaccaactaactaatgaaggaaccacccaccagcacatccagccattcctcctcaacaccaccctggcaaactggaaatgaatccagactcttgggaaaagggattcccatcctatcatttattcattcattcaacaaatacacattgtgtgctgtgtgctgtgtgctgtgcacagttccaagcactggggggctgcccaacaaaacaaattccctgcttatattcaagtgaaaataagaccataagaacacataccatgtgcccaccatatgccacacgctgtgccttgtgcttcacatacacagaaagttcatgccgaaagcctaaggaaataagcatggaccactgtcccctaccacacatggggaaatcgtggcacgaagagctggcccaagtctcagagctacttccactgcctcttagggatcacaataagctctgcctggaaaagcagaattctggggaccccaggtcccagctctagctgagctgaatggcccccaccagtgtttacccctggcacagatgggggattgaggctgcggcagctgggagatgccgggccccacgctgctcacactcaggcctttgtcctaggagccagcacttgccacaggctgccctggtgatgtcagctctgggcagagtgcagggcgcctgggggtggggaagtgctttctagaagcccccagggcttggcgtgagaagggcccatctttgtccaggatcaaggagttttcacaagattttcacagccaccaaggacacttccccacaaacactctagattgtggtttcactttattttcttttaaaaaaaaacaaaaacaaaaaaaacaggcaaacacacacagagctagcattcactattctcactacatttcaggcactatgggaagaacttctgagaagtccttaaatgctcaaaattcacagaagtgagttagatgaggcgtcaacctcatggtcttcccaacctcctaatggcagcacgttcctggactatcctgagtcctccctttctgcccatgctgcccccctggctgatcccaccctgactcggcttttttttcttttttttcctggacagaatctcattctgtcgcccaggctggagtgcagtgtgcaatctcggctcactgcaacctctgcctcctaggttcaagtgattctcctgcctcagtctcctgagtagctgggattacaggtgcacaccaccatgcccagctaatttttgtatttttagtagagacagggttttgccatgtcatctaggctggtcttgaactcctgacctcaggtgatctgcctgcctcggcctcctaaagtgctaggattacaggtgtgagccaccgtgcctggccctgacttggctttaaacaccatctttctttatattgaaaacactcaggtttatctctctagcccctaaactcccgactagagtctctgctgcccccccaatgccccacctggatgtactgcaggtatcttaagcctcacacatccaaaagggaatgtttatttccctctcctaccctagcctgcaccctcttgggaaaatgcaactccattcttccagttgcttgggcccaaaaccctaaagtcatatttgactcctctcgttcatttatatccaaagtcaatgatcaggcaaattgtgtcagctcaggccctcatgctctatgtgaatccaaccacctctcccaccacaaccacgctgttcgcagacaccatcgcttcctgcccggacattgcagtagccctgcagtcggttgaatggtgttccccaaaatgccaggcccccacaaaacctcaaaatgcaaccttatttggaaattggatctttacagatgtatggtaattagttaaaataaggtgatgctggattagaggggggaccctaaatccaatgactcatgtccttatgaggggagaagacaccaaagaaggccatgtgaagacagaggcagagattggagcaatgctgccacaagccagggagcaccgacggccgctggaagattaaagaggaaagacaggatccttccctggagccccaggagggagcacccaccgacaccctgatttcagacttctggcctccacaactgaaagagaatcaattttgttgttttaagcaaccccatctgtggcaattgtcccggtcccctaggaaatgcaaacaagaccctccctggacctgcacttctacccagatactaaaggggggcctttcaccatgcaaattagcttcattcatgcctctgctcaaaaccctcccacggcttcccatcccactcagaataaaacggaacattctctaaggcaaagccacgagctccaacgtgaagggatcccacagagcgatcctacagacatcatgctgcgcaaaagccaccacacacacacacacacacacacacacacacacacgcacatcctgaatgatgccgttcatagacgatgctagaataggaaaaactaagctttggtaagagaagtcagcagagggattctggaggtctgggggccatgactgggaatgggcaagagggaaccttctggagtgatgggaatgttcttcgatcttggtggttccatgctatagacatatgtaagcatttgtcatcctgggggtggacttactgcatggatgctacactttaattaaaaagcttttttaaaatctcatacttggactgggcagagtgactcacacctgtactcccagcactttgggaggccaaagagggaggattgctttagcccaggagttcaacaccagcctgggtaacatagcaagaccccatctccacaaaaaaaaaattaaaaattagctgggcatggtggtgcacactatagtcccagcttctcagaagactaaatgggaggatggcttgagtctaggatgtcgaggctgcagtgggccatgatcaagccattacattccagcctgggtgacgcagcgagaccctatctcaaaaagcaaaaacaaaacaaaacaaaaaatttcagactctttccattgactaaatgctccttcattacctggtttctttcaatctctctgacctcatctcctcctgcttttcctcttatggccttcactctagtcacccttggctttcttgcaattcctcaaacacactcctacctcagggcctttgcacacgcaggtcatctatctctctgaaatgctacatagcccctgcctctctctctctccttcacttcctccacatccctggttacatgtcacccaagatgcagttttcccaaagaccaatctaaaacagcatccaccatcctaacttcctcaaaacatcctgtcacccttattttacatcctccagagaatttaacatcacattatcattgaagttcccccgactagaatggccactctatgagaataaggacttttcttgccttgttcatgtcggatctttagcccgtagaatgatccctaccgcattataggtgcttagtaagaagttgctggatgagtaaatgaataaatcatccccattttacagacaagaaaactgaggcagagaaaaattaagacactactccatcattctccatcactcagctggtgcccagcacaacatggatggaaagccagattctgtctgttcccaaagccttaatgtcccataacagactcatgacagctcttctgcacgtggccaaaagctgggagacgccagcaaggagggagacagatggcacatgtgctggcaccccacgcatcctcccctgcccagaccggcccacccagctgctgctaggaatagggcagtttgacccaccaggaagactgcttgagataggaaggaaagaaagaaagaagtcagtccttcccttcccttcccacaccctgcacacaccttcctggcatcttcctccttcccaggacctagctgaacctgagggaatactgtcagagggtgggaccctcagccagggagcccagagcctgggcagcagggactgtcacagggtggtgctgcctgcaagccaacaggtcaatgcagacatggccatttctgtccatgtggggtcttgcagtaacgtgacttcatctttgcattctgcccagactattttatgaatataagtgcaaacatggaaatgtgaagatgtaggtaccggctatgaaaagcaacagtcctgaaagcttaattcacttgagacaaagatggaaatcagtaaatcagtctgccaatttgcccttcctcagatgttcactggagccgggccaagcaacatgaactcacttgtgaaggaaacacacatttggaatcgaaattctggaactactttgttggagactgagtgaaggagaagtgcaattaggaatattattttatagtttagcactctgggaacgtggttcatactccgtatgctatgttagttaattgttctacttttatatactgaattcggtatgtgctgttgggaaaacaaacagtatgggggtggagagacgtctgtgaccgaatgagaagggattcagaggtgaaagactgggactgaaacccaggataagctcaaccacttttctaggatggacccctagaaagtcacttaatattgtgaagtcatcaaaatcacctgtgacaaaggctatgcagtgtcccctaatgtattcttcttccacagtgatcacatttctagctgggcacatggctgctcagaataaagcctgtatttcccagccttccttggatctaggggtgaccatgtggctgagtgctggccgatgggacgtgaggggaggagatgtgtgcagcttcctgttacgccctgaaaaggagaagggtatgctctccttcccgccctccctccaccccaccacctggaagtaggatgtagtcaaaggtcatctgagaccaggtcaatgagcatcataacctagggccttagcccctgacactggagccactataccagccccagactgtctgcacccacactgttaacaagagggagaaataagagcccaccttgttcaaaccactgtcctttgagatgtctgcaaagcagacaaatgtttatcttgactcatacacaacagatagtggtttgaaaggctcaaaggaggtcacaaatgacaatccgttttatacataagtgaggctctctacaagtgtagggaagaccatcatggatgtctacagtttttcctgaccaaatgcaaatgcaaatatacccagaaatgcaaacacaaatatccccagaaatgcaaaccaactgctttagggatccactctacccttaggctctattgtatgggtagacctgaccccaccttccatctccagaagtgaccaatcagaacaccaccaccaattactctgtctacagcaattggttcagggataaggttttgagccaacgagcatcagacctaggatttttgctgttactatggggaaagggaagttctctctatcctgaagctgctcagctatcagaggtataagtctggagctgctggaggccaccctgttaccacttcgggagagcctgcctgggaataaagccacagcagagaaaaggagagtcaagagacatacattactgatgacatcatttgaacacccagactctgccatctctgtagccctctcaggtcttaaactccccagaaaagtaaatccctctgttgttgttgttgctgttgttgttgttgttgttttgcttctgccagtttttgggtttttttgttttttgttttttttgaggccgagtctcattctgtctcccaggttggagtacagtggtaccatctcagctcactgcaatctctgcctctcaggttcaagcaattctcctgcttcagcctcccaaacagctgggactagaggcacatgccgccacgcccagttaatttttttgtatttttagtagagacagggtttcaccatgttggccaggctagtcttgaactcctggtctcaagtgatccacccgcctcggcctcccaagtgctgggattacaggcgtgagtccccgcacctggccgcttaagccagttttaattggattttctttcatttataattaaataatcctaaaaatactagtaatcctaataaccatcataatgacagtagtattaataattactactcttgctgccatttttaatagaacccttactttagaccaggaatgggcaaagtcaaccctaatctggccctctgcctgtttttgtaaataaagttttattgccacacagccacacccactcctctacacattctctagggctgctttcatgctacaatggcatgagctgagtcgtggtgacagaaactgtatggtacgcagagccaaaaatattccccagctggccctttatggaaaaggcttggcgatccctgctttaggcaggagattaccccagccaaggaaaggatttggcaccatggggcagcatgaagtcctcttgtgcccagattccacaaggatgaggccgagtgcaagggagcaccagggctgacgggtcaacttaccaaaaggaaggcgcgcacggtagggatcttgttcagctccaccagcagcctcagggctttctcatggttgctgcaatactcctcgtacacgcagaacttgtccttctgcaagacaaggacagagcctgtgggaggcaggtcatggtagcaggcaggtgccctgacacatgctgaccactgggctggtagggtaggggtaaggactaccctgacccaggagaagctacagcaggaggtatctcaggtaaagcggctccactcactaccagcttcccagcctccactcttgccccaggtctgcactcaggggcctgaataactttttgggaagcagtgtggcctgggggtcaagagcatagactcaagaagagcagcctgggcttgcaccacggctctgtatttcctgtgaacctgggcaggttacctgacttccctgtgcctcggtctccttatctgtaaggtagagttaataaaagtccctaagtcagagttgttatagctgggggctagctctgttgacctccagatgcccctgagcccaaagatgtactccttccagactaaaggtcacctgtgggtcactaggtccagaaccatcagtcagggtttcccgtactggaagagacaggagccttcttagcaggaagctctcaactgagcattcttggttccagatggttcacagaacccgccaaaccctaaacaaggatggcgtgggtgaggtcactggaggaggaagggttgcaaggcctcaatcctgagctagggatgggggtgtgcaagagacccgaacaagctaaggaaggaagaggtgggtccacaaagcaagcagctcatcttgtttctaaacaagcccccagatggccttccgatgggaggctgcaggaaataggaaaccaaagagaagggaggatgggtttagaattaacaggcatccccagcccaccccagctcactctgggggctctgtgtgcatcatctgagcagacaccctgagccacaaagtgcccaggtcagtgctgatggctaacacagagtacatacccagcacatagtacaggctgcccagcatgtagtacaggctgcccagcatgtagtacaggctgcacgctgctctcctggaatgggggtgaactcactcattccccacgacagccttacatggtaactactgtaacagactcacatacccatgacaaaaccaaggaaaagttgcttccccagggtctcgccgctagtgcagtggcagaaccaggactcaaacccccttaaccccagtgacagtgtcagctcaaggtcatggcatagggtagggatgggagtgggaggcaaatacccagggtacaaatttcaagccacaaatctagactaagctgcatcccaagggcactacaccagaatactgaagggcacagagtgactccagaaacccagttccacattccctaagtagagggtgaccttgggcaagtgcttctcctccctaggccttggtttcctcacctgcaaaatggacatcataactgaccttcaacacttaggatgctggaggatgaaataacttaatatatgtgaaatgagtagaacggtgtctggcacacaatacttcacaatacttcaataccacacaatacttcaaagtactctacaagtattaacaacaaacataaacacaatcgacaaacatggatcaatgggggaaaatatcagacaaaccatgttacaattacccacagtgcacccccatacacacacacataccacaagacacacaatcttgatgcatattccaagaaaccacacaatgatctcaagcattacagcatgcaaactacatgctccaaacaccaccaccaatgtcagcatgcacatggacacatgcactgagtcacaaaccaccactcactcatcaagtatctgcagtccactgagatgccaacacatggcaaggaaggagaagaggggaccccagcacccccaacactgcccaggcagacctttttctattcccacttgtctcaaatgggcctaagggaccatcaaggccaaaagagctgggtgagtagatgtctgagctgcaggggatcactcagccgtaggtaaaaccttgtgagtgggggctgctggacacacctggaaccaggatttcagctgcagactgtggtgatgcaggctgcagggaagaggaagaggaagaaagagtacaactattttgttgtaggtgacaggaactggcctgtctggaaacctgctcctgcagagaagacttgcagtgacataaaaagccaccatgaccactctcaccaaccactatcagcatcaaccctgtaagtgccaaggagaagttctgcagccagaccatctaggttcatagcccaagtctcccggtcaccagctcttggtcaagacaagtaacatttcttggcctctgcattctcatccataaagtacagacaacaatatcattaccataatggtgttgtgaggattggcaggtgaatttatattaagggacttccaatggtgcatagtaagtgttcactaaatattaactagtattattattgcttaataatgttgttgctattatcaccagcatgattatttcagaaacttcattaccttttttattgaacagggtagggcagtaggtgggaaggttttgacagcaaaaaaaaaaaaaaaaaaaaaaaaaaaaagacaggcagagtcaggaggaaggcagcagatagactcgtgggtttagggaaagcatcgggagggtcccaggcagattttgggaattatgatggtccctgaccccaggatgttttacgtctcattcatgcactgtccttctcccctgaatctcctgggactgtcagctccatcgggacggcgttttcatctgttgaggtcactgctgtgatgtcaatggggtcagcggccactggcagagagcaggtattgtgactatttgatgaatgaaaggaagaaaagagaaggaggaacggagaggctaaagggccctcagaccagctctgtgcttcttcccaggctggtcccaccccaccccagggaccataagtgagcacatgacccagacaaaaccaatcagagttccccgtcctaataacagtggccatgtgacccaagctgggccgcaagagcccgcaaggactcgagctggaatcactgggaagagaaactctctttgagctgctgttgaacccctgccaccatgtgaggcatgcaccccataagcccctcccattctccaagagtgaaatcagcactgcacagataaaagcagagcctgagatcagagaaagacctggtcctgaaatcatcatacggagtcctggatctagctatgcctgaagccaacctacactcctgaacaatttcactgacatgcatcagtaaagtcctgtatttgtttaagcctatctgaactggtgtttctgtcacgtacagcaaagacagttttgatacatgcacactcttaaaggcagaaaatgaaagacatggacccaaatcttagtgaggtgacagggtctctctgtccatctccacagagatgaagggaagggactgggccagaaagcagggacaaatcggtttcttcccacataccaaccccagtcactgggtagtgccagctggaacactggtgaggaggattctggggccccacaggaagcctagagacagaatgctgtgattgattaggaatgtctgccacaggtgcaggagagggggtaacaagctcaccactggtttgtcattcctcatcccctgagcccccttctacgacaaggtctgcaatgttttcctctccttcagcctgtgggaagggcaggggcccaacgcttgaggcttggagaagttaaatttagcaaaggacaacatcccctctgcagcaccgtgcccagttcaatcacgcctgtgtcctttcatccagcctgacccca
